United States Patent 12,157,898 (METHODS AND COMPOSITIONS FOR MODULATING A GENOME) - sequence listing, part 2

SEQ ID NO: 2577 - DNA, 174 bp, Gossypium arboreum
  source 1..174: mol_type = unassigned DNA
tagaccgaacggtcttgtaataatgtagcccatttaatttgtaagactatgtgtagtgaggctaaaaattgtttttttgatatggattatccttcggaaatccatgatgctgttattagtgatgttacttaataatatgtgttgacccttgtggtcgtttttgctcaaaaaaaa

SEQ ID NO: 2578 - DNA, 338 bp, Harpegnathos saltator
  source 1..338: mol_type = unassigned DNA
tagcagggaggggggtaaggagggagggtggatgtcccctccctccttgacaggagacaccagaaggccaaccggcggggcaacccgccggggaccgcgccctggattcccttcgtggaacagggcgcggtacacaggtggcgaggggctcccggaagggagccctggggccggggggttggggagggaatacgggagtagttcccctgactcccctcctcacggtccgacaggtagacatcccgcaggggttttagtcggtaagagtccgacataaccccctcccccccaagggggggggtatccatgatggatttcccctgcgtgaccaaaaaaaa

SEQ ID NO: 2579 - DNA, 322 bp, Hydra vulgaris
  source 1..322: mol_type = unassigned DNA
tatttcaagttatttgatatttttgtcgactgtgtgatgaatattatttaaacaatatatgctgaatactttatattataatattgttcaatattgagaatgttatatatccatattataaaatattatgttaaaacttgcttaacatctgaagaatattctaacgcttatgtaatttttaatatttgtaaattttctaccttttaattcgttatatagattgtaaagggcttcatgataagatcatgtgatcttctggaagtcctaccagtaatatattcaatgtaaatttaccttgttcatatttttctggaaaaaaaaa

SEQ ID NO: 2580 - DNA, 98 bp, Hydra vulgaris
  source 1..98: mol_type = unassigned DNA
tctctatgactattatgaaactgttaatagcaatggctcataatagattcaacatggcgttgaatctcaaggagcataaataaataaataaattattt

SEQ ID NO: 2581 - DNA, 411 bp, Hydra vulgaris
  source 1..411: mol_type = unassigned DNA
aacattaaaccgatacaacacgcgatctaccggaagatttaaaaaacctttccgttcatcaaaacttacgagctttgccatttcctatcgtggcccaatgctatggaaccattttacaagtctgagtggtaaacttaaagaagccaatacctctcaaaaatttaaaaagaacataatcgaacttattgccaatcacgattctttacatgattttttctaacaatacacgattatttccaatttttattatcaaaggttactgatgaaaagactttatcttcttcaggttctccggtcttgtaactattataaataatgaaatgtacttgtatttaatatttctaaatattttacggaaattatctttaattgtaaatggttgcttgacaaaaattgaaataaaaaaaaaaa

SEQ ID NO: 2582 - DNA, 523 bp, Hydra vulgaris
  source 1..523: mol_type = unassigned DNA
aaacaatttaaaggtttaaactaaatcacttaaaaataaattaaatctttaacactttctttagcttttattaaaatggtttcaaaccattagtataaaagataacgaaaataaaattgtctttttcgttcatatttttgatgatattaaataatcagcccaaatacttatgtttacatatattgcttttttttttttttaattaaacaacacattttttttgtgtgtttttataactttcatgactttttgtcgtttttacttttttatttttaaaattattctgcttgaagattgttagcaacaaattattttattgctgaagtttttgatttgtttttgtttttgtatttatactgtctttttgtcttttatcatttattgtgcatgtaaatttttgtgtgacggggctcggtgataagacaacctgtcttcttcttgctccggccaggattttcttttattgtaatttcttttttgtaatatttatcaacggcaaattaaataaataattaaaaaaaaa

SEQ ID NO: 2583 - DNA, 585 bp, Hydra vulgaris
  source 1..585: mol_type = unassigned DNA
atatttctaccaactaatattgacattctttactatatatgtcaattcgtaatccttcagtttttaatttgatatttttaacattttgaaattctctacttatctatctacatctaatttctctggttttctatctgccatttttaaactttattattaaactatctatactaatattattaattttagtaccaatgggttggcattctttatttatctatctatttatctcttttcattcaaaaattctctatttctcaactattctacttcgtactaaatctttgttgttgccatcactctttactaaatttttgttgctgctgttattgtctttatttatgaaattcttctcttattataattgttattatttcgttactattattattattgttataattattatttttgttgttgttgttgctattattattcttatcacaatcattgttattattgttattattgttattattattttaytgttattattgttattactattattattgttattattgttattactattattgttattattgctattattagtattattaataacagttattattatta

SEQ ID NO: 2584 - DNA, 419 bp, Hydra vulgaris
  source 1..419: mol_type = unassigned DNA
catatattttatagtttacagtatttgttttcagtatttttttatttttttatttcttcttcttcttatttttcttgtttttaatattttttgtttttgaatttgttacactaaaaaaatatgagctttgtttttattgaatttttattttatttttaaaaattaaattgtttttataatgagtgactataggggctctatgaaaaggttgtgatgttaaacacatcatccttaccttctttgagtccctgactgattagaacagaatatacataatataaaataaaaaattatgaaaaaacgttttttatcatgtttatctttacgacgtgtattttatgtattttttacatgattatatgaaaattgttattgtaactgtttaatcagcaaaataaaagtwtatataataataataa

SEQ ID NO: 2585 - DNA, 539 bp, Hydra vulgaris
  source 1..539: mol_type = unassigned DNA
atcttatacctttttacaacttattatttataaccctaacgcagtgcttctattcatcttttaatttttctcatttctatcgtgatatattactaattttaatatcaattattaaatttattattataaactgatatgtttctatagtattctcttatcactgttgttgttattattactatattttatatcgtaatgaatattattgtaattgttattattgttgttgttattatttttgttgttattattgctattattattgytattattattattattattattattattattattattattattattattattattatagtatattctttttataatcgctactattattttttttatcactataatcactactattacttttattattcctacttgtattataattattattattactatctccatcttatttttatttattttgacaggtgtttactttatattagtacaaattactatttgtaaatatccttgatgtaacaactttattcagaatatatwtgatttgattt

SEQ ID NO: 2586 - DNA, 416 bp, Hydra vulgaris
  source 1..416: mol_type = unassigned DNA
tcaaatacaggaaacacagaataaaaaatcctttacaaacgaagcgtttgatgcatgcaacacacttgatttaaatttcatacagtgcatgttaaatggcaaaaaaattaaattgacgcaacccgtcgtagagctacaaactaatgttatgctaatattgaaagaaacgttccagttttggaatttgaaagaaaagagagaggcgtttaaaatcttgatggaggagaatgttcctagaactctgtcccaataatatgtggaaaacaaaccggctgtttataagcatttattgctaacaactacaagagagcccgtgttgttttagctgatttttaatttattgtttgactatttaaatattattttacctgtaatttattaccgggtgataaagagaaaatataatataataataa

SEQ ID NO: 2587 - DNA, 1475 bp, Hydra vulgaris
  source 1..1475: mol_type = unassigned DNA
aaactcaaaaattatggtataaaaaatacaaatttagcttggtttaaaagttacttgactaatagaaaacaatatatttcatatgatggmggaaaaactgaatatatgacaattacttgcggtgttccccaaggatcaattctaggaccacttttatttctaatttatataaacgatttaaataaattttctaacattttaaactcaattttatttgcwgatgatactaacttattttattctaataaagatattaatattttatttaaaacagtaaacaaagaacttataaaaactaaccgaatggtttaaatcaaataaattgtccttaaatataaataaaacaaaatatactttatttcatcgtcttcataaaaaagaaaatattccattaaaacttccaaatctttttattgataactcattaataaaaagagagcaatcaataaaatttttaggcgtkattcttgatgaaaatwtaacatggagggamcacataagtataattgaaaataaaatttcaaaaaatatwggtatattgtataaagcaaaacagtttttaaatcaaacttgtttaaaaaacttatatttttcttttattcattgytatctaaattatgcaaacattgcttggtgcagcactaatgcaacaaaaataaaaaaactgtttagtaaacaaaaacatgctataaggatwattacaaatgtagatcgtttctctcatactaaaacactatttaataaacttaatattctaaatgtatatcaactaaacctttatcatattcttatttttatgtttaaacttgataataaaatatcaccaattttatttaattcattttttaaaaaaataaatcatatataccctacaagattttcaaaaaacaattatattcaatccaaaacacattattcagcaactaaattctcaattgcaaatcgaggtcctaaattatggaatacaatattaaataatgagcttaaaactaattcttctttaaaccaatttaaaacaaaacttaarcaaaaacttttgataaatgaaaatgaattaaatttcttctaaaaagctttttaaattagcaaacaaaaataaaaattaatctattaattactctttaatattaatttaatattttaaacaattgtcttattgaaatctatttattatcttataagttttatttacgacgattttttaagttttattattttttttkaatttctttttattattttcttttttattartacttacttattttactaatcaattattattataaatttttcgaattacwaaatagttatatattttattttttattttgttaacgttttacttatgaatgcattttggggcttagtgataagacgaattttgtcttcttctagccccagtcatgtaaatatttgtttttataaattacattgtaaattattttcaacggcaaataaataataaaaaaaaa

SEQ ID NO: 2588 - DNA, 444 bp, Hydra vulgaris
  source 1..444: mol_type = unassigned DNA
aaatttatgtaaaatgtatttttcaaatcttcagcatattgagtattaaaatgttagtatattgtatatttgcattatgttatattgtattagtatattgcatatttgcattatgttaaatctttgcattatgtcttttttaaggttccggtgataagatccttctgatcttctttcggaaacctagtcttatattgttagtacgctgaattgtatatacatatatatatatatatatatatatatatatatatatatatatatatatatatactcattttttttttcttttcttgtagaagtcttaaatatttttatgtatcagacttatattattatatatcacgacttatattattatatatgtatcagacttatattattatatatcacgacttatattattttgtatcacgactaacattgtaaactaaaaaaaaaaaa

SEQ ID NO: 2589 - DNA, 487 bp, Hydra vulgaris
  source 1..487: mol_type = unassigned DNA
ttttttgtttctttttttaactttatatttaacactgcattaataaattttataatttaacaatttataaacagttgtttaacacttttgttaaaggtatcttaaaactgtataacaaaacctttaacaaaaagtttaacaattgtgctaaagatatcttaaaactgtataacgcatctatgtatttataacggatttctttttctttttttctttaaatttgtttatgttttcaattcttaattcttaatwatttgttatcttcatgtatgttaagtatatattcctattgaaagtttatttattttgagaatattttattaatacgaaatattaacacgaaaattttttagcggttctcgacgacaagaccttacggtcttctacgagtwcccgcgttcttttatttcttaatatcatttatattattatatcattgttaacgaatatttattaaatacaaagttgtaataaagaacaaaaaaaa

SEQ ID NO: 2590 - DNA, 104 bp, Hydra vulgaris
  source 1..104: mol_type = unassigned DNA
cgttttttattatttagtgactgaactaacttgttcattaattaatttataccggctgtcatagatattgcctggcgctttatctcaacagcattaattaataa

SEQ ID NO: 2591 - DNA, 152 bp, Hydra vulgaris
  source 1..152: mol_type = unassigned DNA
tacaattttgttgtaacttgtccagcacttgatacaatttaacatttcagtaaaaaaaaaaaaatgtttttgttaatgtatactcagtgttagtggccttcgggtccttctgttgttttcaaataaataaataaataaataaataaatatat

SEQ ID NO: 2592 - DNA, 974 bp, Hydra vulgaris
  source 1..974: mol_type = unassigned DNA
taaaggaatgtcaaagttatgattttaaaaagtcttcattttatttagccaaaaggaaaacaaaatacgaatataaaaatctaactgtcttaactctttacaaattattaaacaaaccaacaaaagtttagactataaattttataaatggaaagattgttttgaaagcatgaaaaatataaatgaaaaagattggaaacgtttctttataaatcttcaaaaaagtaatactaacaacaaagcgtgcgaaattctatttaaaacagcacactttttgttgccaaccaacgataaaatgtttgattttaaaattagaaaagacaaactttgcccacagtgcaaacttaaaaatgaaaatactgcccacatgatgtatgaatgtgaaaaagtacagccactaatattttatgttctagatattttagaccagctctaccctactgaataccctcataataacaattttaaatttattttatttggatacgaaaaaaacgcagcccagaggctttttggcagtttattattagaaagttttatttgtgaaatatattttaacagaatgaaaagtcaattcgaaaagaaaacattcactaagaaatatttgctagaaaagtttgatagaaaagtcaaaagattatttttaaatgagttacttatgctgaggcaacaaaataaacaagaaaaacacataaacgaaataagaaacatttttaaaaatggaagattaaatttgatagcagatgttcgtgactatttcgtataattttcgttttttctttttcttttttcttttgttttttcgatttttattttttattttttatttattttttagttttattttatacgggtccaatggacatctttgtaaacgttttttttcgttttttcgttttttttttaaaccttgtatttattatgaggacgtcagtatggcaattagccggatgacggaataaattacaatacca

SEQ ID NO: 2593 - DNA, 537 bp, Hydra vulgaris
  source 1..537: mol_type = unassigned DNA
agtaaactamaataaaaaaaaataaaaaaaaacagattcaattatatcaatgatatatgataatatgaataagaaaagaaagaaaaaggaaaaaaaaaaaaaaaaaaaaaaaaaaaagaataagaaatccaagtgatgatgtcacaagtgatgatgtcataagtgatgatgttacatattcatttagtgttaattatgagattttattttttcaatttcttttatattcaatttttttttttttttttttttatattaacttatttcttaaacattttagcaactgttaagcatcttaacgcttcttaattaattcttattttttattttttttattatattagttattttctatttcatttctaattgtttcttttatatttatatttgtatgttacggttatgtagaatttttaatggggctcggcgataaggcgaaatgtgccttcttcttgctccagccatcaatttatataaatgtatatgcaatgtaaacattttttaacggcgaaataaattacactaaaaaaaaaaaaa

SEQ ID NO: 2594 - DNA, 76 bp, Hydra vulgaris
  source 1..76: mol_type = unassigned DNA
tggggtgtttcccctgctcgctgtatgtgtacattctatgtaaatttacggctacaactataataataataataaa

SEQ ID NO: 2595 - DNA, 189 bp, Hydra vulgaris
  source 1..189: mol_type = unassigned DNA
ctggtttttgttttataactatggtcttatatataattgtaatatatattttaaattaactagcatttgtattatgtgattgtagggcacgttgtcagagtccttcatattttatggacctgcgtgtcctttagaacatgtatcactgttctaataaattttaatctaatctaatctaatctaatctaa

SEQ ID NO: 2596 - DNA, 293 bp, Hydra vulgaris
  source 1..293: mol_type = unassigned DNA
cttttcttaccgagttgttgacatgtggaacaatatgacctcggaggctgtaaatgcaaataacattttaatgttcaaaaataaaattaaatctttcgactttaacaaatatctattgtaaaaggaacaactatttgtttctttatagttttgttattttattttttttttgtagcgatatttttaaatttctttgggcacgttgttagtgtccatctttgtatgggccttcgtgtcctttagaacatgtatttatactttgttctaataaatatcaatcaatcaatcatcat

SEQ ID NO: 2597 - DNA, 512 bp, Hydra vulgaris
  source 1..512: mol_type = unassigned DNA
agactctgaaatatgttgttatgcttttattattactactytcttgatacctactagttttattattaactttttgttctcatatttttattgttattattagtattgatattaataatattcttctatctttattagtaaattgttatttttatttataacataataagtattattattgcttttttaattttttcttaagtttatttactacttatactatgtaattgttattaccactattattgctattatctaatattgattgtataatatctttattattattgttagtattattactaataatattccttttcatcgtcatcttattattattgttaatattatttctataattattatcaatactattattattgttattataatcacttttattgtaatgttgcaggtttttactttagattagtacttgtactatttgtaaaagtccttgaaattttacaacttatttcagaatatatattgaattgaattgaatatatata

SEQ ID NO: 2598 - DNA, 317 bp, Hymenolepis sp.
  source 1..317: mol_type = unassigned DNA
taaagcccgaacaaaggagaagcagtggacagcggcactctccaacatagccgactggcctagactcgaagctgttgcagaatttagactgcgtaccggacacgattgcctggcgaaacatctccacagaataggagtatacgcccaaccaacatgccccctatgtgaccttcaggaggaaatggagaagacccatctgatacggtgtccagccctacagacagcgacagaaacccagagatactgggaagccagaagtcaactaaagggctaatgataactattataaagcctgccatttgatataataataataa

SEQ ID NO: 2599 - DNA, 111 bp, Ixodes scapularis
  source 1..111: mol_type = unassigned DNA
tagtcacgaccttgttttgttgcctgcatttatccttgatgacgagcggtgtaccactatttaggccttgtgctgtttttggacacccaacaaaaataaagattattatta

SEQ ID NO: 2600 - DNA, 167 bp, unidentified
  source 1..167: mol_type = unassigned DNA; note = Description of Unknown:Locusta migratoria sequence
tgactgtgttaatttattctttgtgtgctgtatgcatcttatataccttattttatgtctcttttgtattcttgtatgttttacacatttttgtattttttgtatgtatagttgtataagacctgctaaatgatgtgcactgccatacgataaataaataaataata

SEQ ID NO: 2601 - DNA, 484 bp, unidentified
  source 1..484: mol_type = unassigned DNA; note = Description of Unknown:Locusta migratoria sequence
tgactgcaacatcaggtctacccaggccaaaaacagacctgtataaagtgacagatgatgcaatttcatggctggatggtttagacattaatatataaggaccatgttcgctgcttatctttcttaattcagttaacataaattgtgtaaatttactgctcatttcattgttgtttttctattacttattttagtttcctaacttaatgttcctttattagtgttcattcaattgttcatcttactgtacgatgtatatatctttcataaatttgtattaatattttataaatatttttttccaaattccactgcatcacacatgtaatggactttttactgcatacctgtatacttctctgtaattaatgcacttaaattttgatataagctgtttgttgtctctgcttcccacctggagaagtgtcattgtgtaatgtatcttcatgtccaagtgtttatgtcatacgataaataaataaat

SEQ ID NO: 2602 - DNA, 799 bp, unidentified
  source 1..799: mol_type = unassigned DNA; note = Description of Unknown:Locusta migratoria sequence
tagaaattggtcttcaggagagggacctccgattaagttacaccagaaggtacttgggctttggaacactgagtgggttgactcgcctgccccaaacaagctccgtgcagtgaagctttctacagctccatggaagtcctccctgagggcctctcggaaggagtcagttgtcctttgtcgcctgcgtattggtcacacgtggatgacacatggccatctacttcgacgggaggatcctccacagtgtcgctgtggcactttattgacagtggtccacattctgttggactgtccccttttagctgccttacgacagtcttttgacctgccagctgcgcttccttttatgcttggtgacgacgctgctacagctgatcgtgttttacgttttatccgtgcagctgggttttatcatttgatctaaaggtgggtacctcagcctgatctctcaggcacccatctctcacagatttttactcttcttattttgtgttgtctgacctgcttttactcgtatgttttagaatgtgcagagtggctggctcatcctttattatcctcgtgatcagccagccacaatattctgctgtaactttttagtccagttatgtttatttcctctttgtgttttctttttggtgttccgagctagtgttccttatattgtgtacccattgtgtgtttctcttctgtgtgattcagcgctcgttttttcagcttgcattacactgtattgtctttgctcgcaacaggggactgatgaccagcagtctagtcccctctaaacaacaacaacaac

SEQ ID NO: 2603 - DNA, 100 bp, unidentified
  source 1..100: mol_type = unassigned DNA; note = Description of Unknown:Locusta migratoria sequence
tagtttgttacacgtgtaatattatatgtatctttgttattaaaacatcaaataactgtaaattttgtgatgtagccatacgctaaataaataagaaata

SEQ ID NO: 2604 - DNA, 87 bp, unidentified
  source 1..87: mol_type = unassigned DNA; note = Description of Unknown:Locusta migratoria sequence
taaaatatgtagaacgcctggttaggtgtaagagagggcctgaaggccctaatcttgccaggttaaataaatgagtaaataaataaa

SEQ ID NO: 2605 - DNA, 103 bp, unidentified
  source 1..103: mol_type = unassigned DNA; note = Description of Unknown:Locusta migratoria sequence
taaataattgtcttgtaaatatgatgtattcacataacatgtaaatattgtacattagtttatacattgtaagtgcttctgacacgaataaataaataaataa

SEQ ID NO: 2606 - DNA, 248 bp, unidentified
  source 1..248: mol_type = unassigned DNA; note = Description of Unknown:Locusta migratoria sequence
taacagtcactatcgatatttttgatgtttggtcatctttggttgtgttgactctgcagtgacttgtactgtgtgtgttatcttccttgtttaccctttgcaaaccgaggtattaaatacgcttgcacattgcttccttgagtgcagttgtgccttgagaatggcagggtgtcctcctgccgaaatatcggcggttgtcgacgacgtcacccggcagcatacccgtaagttgtttgaacattcattac

SEQ ID NO: 2607 - DNA, 103 bp, unidentified
  source 1..103: mol_type = unassigned DNA; note = Description of Unknown:Locusta migratoria sequence
tagatgtttgttgtgaatacatgtaatgtaatatatgtaatgaatgtaccataatgtaatcagacactgaaatgtacttaaatgccatacgctaaataaataa

SEQ ID NO: 2608 - DNA, 666 bp, unidentified
  source 1..666: mol_type = unassigned DNA; note = Description of Unknown:Locusta migratoria sequence
taaattgtaatgccttattttactagttataaaatccttgtgtaatcacaactgttttggctgcttatgtgatataaacttaatgtcttattttactagtaaccatagtttaatttaaccagttaaaattttaacatatatttacagatgtttcattcaactttgtcacacgcttccatgttccagacattggacctgtttaagataattttttggtcaagtttaatttaaccagttaaaattttaacatatattcacaacgcttccatgtttctagacattagacctgtttaagataagatacgttttgatcaatatttttcagccaatttctattgtttcactttatatttcttaggataacgtcataatctattatattgtcacgtattttatcaatgtcaggaatttacaccacaacttgaattgtaatatttcccgcaggttagttataaaccaaaacactagtctcctttgaaagttatatatctagcaagttaagatctttgaaacttaaacttgtaatgtttacctgatgatggcgtaacagccgaaaaccggttcgtaaaccaataaatttgcagaatatctcacagttatcttgtgtatttcattcataatgtatcaaatattctgtcaagaaccgacggaacagtcagtgaatat

SEQ ID NO: 2609 - DNA, 339 bp, unidentified
  source 1..339: mol_type = unassigned DNA; note = Description of Unknown:Locusta migratoria sequence
tgatatagacgtacacagaattttaaattgtaacattaccattgtgatatattgagtcactgttctatattgtactgtacaacaatgagatagaggactttgaccattsatgtagatgtatacagaattttaattgtattttttctaacaaatttactattgttactacttttcattgtactgtattgtattaggaaaatttaaaactaagtatatgataattgtacctatgataaacactgcaaattactagctgtttagatatgtatttaaatgtatatgacgacaccaattacatgtaaacatgtttaaaggtgaataaaatattctattctattc

SEQ ID NO: 2610 - DNA, 377 bp, unidentified
  source 1..377: mol_type = unassigned DNA; note = Description of Unknown:Locusta migratoria sequence
tgagtcctctgggtggtcttttagatcattatctatgttccacttgacgcgtctttcgactacagcttttcttgtgtacgctatgtggttggcttttccctttttatacccatggtcggtcaaccacattcattggctctgtcatttttatctcgtatttgttactgtgtgtctggcgtcttttgtatcgtctcttgttgactctgtcaatatttcattgacggtgcgttcttttattctgcgctattttaaatctagctcaggcgcatttatcgacgattatgtttttctgcgtgtcgcctagctatgaagtgggggactgatggccatagtagtctagtccccctaaaaccccccataccaaccaaccaaccaac

SEQ ID NO: 2611 - DNA, 425 bp, unidentified
  source 1..425: mol_type = unassigned DNA; note = Description of Unknown:Locusta migratoria sequence
taaaatagaattttgtaatgaagaactgtgacaaacatatatatgtaaatttgtattactgtgttaaagtgttctaataatatatgtgaaattgcattaatcctataacatttaatacttatctgtaaaattaattacctgtgtttcatggtattcatttattaagtgtgtttcacggtgtatattcatttactaagtgtaccagtacttaattttgagtcaatcatattgtgtaaaacctttcaccattatattcatttattacatataccagaacataagtcataaattgaaccatattttatgtaggcctaactacgcttttttgttttgatttaatgtcaatcatattgtataaaaccttttgtaaatacctcatgacaacatcgattgcatggacatgcttaaagatgaataaataaata

SEQ ID NO: 2612 - DNA, 106 bp, unidentified
  source 1..106: mol_type = unassigned DNA; note = Description of Unknown:Locusta migratoria sequence
tagtactgtaagagccttgtattgttagaatagctgtataagaacaatgtaattaactaaagaatatttgcctttgtatatgccgaacgagtaaataaaataaata

SEQ ID NO: 2613 - DNA, 62 bp, unidentified
  source 1..62: mol_type = unassigned DNA; note = Description of Unknown:Locusta migratoria sequence
taattaaacaatgtataaagtgtgtaaagatagcgatgtatgccatacgataaataaataaa

SEQ ID NO: 2614 - DNA, 441 bp, unidentified
  source 1..441: mol_type = unassigned DNA; note = Description of Unknown:Locusta migratoria sequence
tagttcctgcctctaccacccttcccttcctctccctgccactctctatccttacattcgtctcccatcccgccacacatttcattcccttcccttccttttccgcactgtccgtcagacagcactggcgtattcccccacccatgccacacatcccccccccctcctctcctgcttccctctccttgccacctcctcacccccaccactggttgctctcgcctaggatgccatgctgggtagcgcagatcggccacagcggccggagacggcggtcgtgtcgtgtgtgtgtgtgtgtgtgtgtgtgtgtgtgtgtctctaacgacgaaggcctaaaggccgaaagctataatgttgttgtctgttatttgtgcctttctgcggctcatcggacatctctgtggtgagtaagcaacctatccttctcaaaaatattgttga

SEQ ID NO: 2615 - DNA, 15 bp, unidentified
  source 1..15: mol_type = unassigned DNA; note = Description of Unknown:Locusta migratoria sequence
taataataataataa

SEQ ID NO: 2616 - DNA, 414 bp, unidentified
  source 1..414: mol_type = unassigned DNA; note = Description of Unknown:Locusta migratoria sequence
tgatgcgacgggtagcatacctcgcaggcgcacaccgaattcgaagccaggagagtagcgtggccacgataacattctgtagtggtcaccaamagcagaggagatcgccatgaaagtgctaggaacgcgcatggcgggcgcggaccacctatggaacgcctgggacggccgccactagagagccgcagggcgcggaccgacgagggatcaccagcgtcagataccaccgccagactggagcacattgggcgcggaccgcatagaaagcaccagacgccgcctaggcataaatatgggacgcggtcggcttgtcgatcagtctcagggaacacctgatgaagacgccgagttacggtgtcgaaatatcgtgtttggaagacgcggatcaccggcagtacacccgattccacgaga

SEQ ID NO: 2617 - DNA, 178 bp, unidentified
  source 1..178: mol_type = unassigned DNA; note = Description of Unknown:Locusta migratoria sequence
tgacgtcacagcccgcagtgcagctatataaggacgacagcagcaatcactcgacagtcaaccacttgacaatggccgaggagatctcggccgaaacgtcgtggacagtaaaccacatgacgcggctggaagcccgagaaaattttatcaacataactcgcgcgaaacaatgcattca

SEQ ID NO: 2618 - DNA, 269 bp, unidentified
  source 1..269: mol_type = unassigned DNA; note = Description of Unknown:Locusta migratoria sequence
tagccttgtttcgacccatcgttttgccgattttctccaccggcgcgctactagttctattgcgcctagagggcctctactttggtttcgcgcacgcgcggtgggtcgtcagcggtgtataaaggggccgctgtttctcgttctgcctcagtttccggcgagtaagtgtatcagcgcactcacctgaagatggcagccagttggtctgccgaaatatcgtgtctagttgacgacggtatccggctgcacacccgagatgaatattatca

SEQ ID NO: 2619 - DNA, 107 bp, unidentified
  source 1..107: mol_type = unassigned DNA; note = Description of Unknown:Locusta migratoria sequence
tagtggttttgtaatttgtttatatataatctcttttgttttgtattatagttgtactcttgtctttgaccttttgtatgcaacgcttttgacacgaataaataaat

SEQ ID NO: 2620 - DNA, 454 bp, unidentified
  source 1..454: mol_type = unassigned DNA; note = Description of Unknown:Locusta migratoria sequence
tgatgcttgtggcgtgcaaatcactatacgccacattttaattgagtgtattttatatcgtgctgagagggcagcggctaatcttggtcgtgccctacccactgttttagctgacgacgaggcgagtgtgacgaacgttttacaattttgtgaacgttcccgactctggcctaagctcttaggctggaggttttagtgtgttacaggagggctcgctgatgcctctaacatcagcgatcagcgtccctctatactccgacattttcttttaaggacttgtaaggttggatacttcagtctgccaccttacatcgctgatttgcaatatgtgttcgtgttgttgccaagacctacattctattgcctgttcttatttatttactgttgtctaattcttttgtcagggcgctaaaaaccttgctgttgtgcgcccaaaacatcctatcctatccta

SEQ ID NO: 2621 - DNA, 179 bp, unidentified
  source 1..179: mol_type = unassigned DNA; note = Description of Unknown:Locusta migratoria sequence
tgacgtcactggcggcggcgcggctatataagcacggcagcggccgcgaaatgacagtcatccacttgacaatggcagaggagttctctgtcgaaagctcgtgggcagtaaaccacatgacgcggcttgtaacccgagaagatttcattaatggatatcgccgcgaaaacatgcactca

SEQ ID NO: 2622 - DNA, 147 bp, unidentified
  source 1..147: mol_type = unassigned DNA; note = Description of Unknown:Locusta migratoria sequence
tagtattttctctggtttgtttgtttgcttgcttttattatgcatatttgtacatagtttttgtatttgtaattcttctatatatgaaaattttcaaataagactgtagcatgaccatgtaagccatacgaataaataaataaataa

SEQ ID NO: 2623 - DNA, 564 bp, unidentified
  source 1..564: mol_type = unassigned DNA; note = Description of Unknown:Locusta migratoria sequence
tgatgttgtacttcgtgcagtgtccgaaatatttcttccgacttgatccaaagcatttgtattccaaaagccaatttttaactgttttgcttattaaaactttgttactcgtttattctctctactaatattgtattgccaaaatgacgcctcagccatctctcatgttaaacaaagcattttgtagcaattgttttttcaatactgtttctctctgtacagtagcctagttgtaattgcggctactagatggcactactgaggtaacgtcttcctgttcacaactccacttagcacacgccagtctgatgcctccgtgcaggcgtgcagcccatagtggctagctttttctaaaaatttctttttaaattttgtgacgtaagctttacagctgagttgtatattttattatgtgacttgttttattttataatttctgatgaaggcaatcatagtcattgccgaaaccaggttaaataatttttaatttgcgaccgagggctgcwtttttatcctttgacgttgtaacggtcgctgacaatagcagctatgttcaaaatttta

SEQ ID NO: 2624 - DNA, 272 bp, unidentified
  source 1..272: mol_type = unassigned DNA; note = Description of Unknown:Locusta migratoria sequence
tagtgactgaaattaagtgtaacagattgagatggctgggccatgtagagcgaatgtcggaggatcgagctgttaaaaaggtctacaaggaaatccaggtgaaagaagcaaagggaggcctcggaaacgatggctggaggatgtggaaaacgatttgagaaagatgggagtaggagatggaggaaacgagcagaaaatcgtcaggattgggctgcgatcatcagagaggccaaggccctacatgggctgtagcgccaaggagtaagtaagta

SEQ ID NO: 2625 - DNA, 85 bp, unidentified
  source 1..85: mol_type = unassigned DNA; note = Description of Unknown:Locusta migratoria sequence
taaatagtataaggtggttcgatgaaccctctgccaggcacttaaatgtgatttgcagagtatcccatgtagatgtagatgtaga

SEQ ID NO: 2626 - DNA, 19 bp, unidentified
  source 1..19: mol_type = unassigned DNA; note = Description of Unknown:Locusta migratoria sequence
tgagaacgagagaagaaga

SEQ ID NO: 2627 - DNA, 191 bp, unidentified
  source 1..191: mol_type = unassigned DNA; note = Description of Unknown:Locusta migratoria sequence
taagctaattcatttttttctttattgattcttttcactttgtcttaagattgtcgtgtgcataggactacttaaaaattttctattaccattcttgtgtaaaaattaatgtattgacttgttccatgaccatggagtctcactcctcaattgggtcctatggaacagaaaaaacaataaataaataaata

SEQ ID NO: 2628 - DNA, 584 bp, unidentified
  source 1..584: mol_type = unassigned DNA; note = Description of Unknown:Locusta migratoria sequence
tgacctctctctgtagattgccgccgcctcctccctccccctcccgtcccccgcttggctcaccccctcctttctccacctccccgggagctccttccttccggtttcccccattctcccctcccccacctcccttccccttcccccgcgccttctccatcctcccccctccccctgcagggccagtacagtgctagtgtttttaagtgttcagtgcttcgtgtgtatagtgtttcgtcgcccagtgttttttaacgttgcgtacacgcctgtgggaaaccagtgttcagtgttttttacctcaatgtcgccgtcatgttatgtctcgtcgtctgcagtgagtgttttttagccaccgtggcaatgtcttgttttaacaaccatgtatgttctgtccactgtcatgttgtcttttaacattctcccatattttcatcttgtaattgtaaaagcgccattttatcacctttaattttatattctgttttgtccattgtttaccattcgctcggctgtagagcagcatcatcggctgctgccagcctgcctgtattagggcattaaaattcaataaaggaaaaaaa

SEQ ID NO: 2629 - DNA, 263 bp, unidentified
  source 1..263: mol_type = unassigned DNA; note = Description of Unknown:Locusta migratoria sequence
tagtgatgttttatctctgacaaggactatctctgctgataacgtgacagcttggccacgcccacttttcacagtatatatggcgctctcagacacccgactcatcagtcggcaagactcaacgcaagtaagaagacctccgaagatgtccggcgcagctctggacgaaacgttaggagaaactgaaaagttttatggaccacggccttataacccggaagttctaccagcaactatgatccggtcgtgaaagccttcatgca

SEQ ID NO: 2630 - DNA, 104 bp, unidentified
  source 1..104: mol_type = unassigned DNA; note = Description of Unknown:Locusta migratoria sequence
tagtgtaaaaccttatgtactaggtgtattcatttctgggcgtattagtatgttggaggtaaacctctgtaatgaggacaatctcaataataaaataaaataaa

SEQ ID NO: 2631 - DNA, 435 bp, unidentified
  source 1..435: mol_type = unassigned DNA; note = Description of Unknown:Locusta migratoria sequence
taaacaatcccactgccaatcatagataatagcgcaacaaaattatcaaagataaaatatcccaacatatttcgttcaattttaaataaaagctttgcctcatagatatatattctctgtgcaaataatgtaagcatattacatctctgtagagctgtcaagtaaatgtcaaaatccgtaacttgataaagatcttgcatgacagcacaatattataagttacgtgatatataatacaacataacagaatgtggtatgtagcatttcttttacatctgtataaaacaagtaggcagcatagtataaatattatgaaaacttatgtattgcaggcataacacctgaagatgactattaagtcgaaataagcttatmgtgtaactaatacgaattaaaatatacagtgttgaaattatataattgttattattaaaa

SEQ ID NO: 2632 - DNA, 30 bp, unidentified
  source 1..30: mol_type = unassigned DNA; note = Description of Unknown:Locusta migratoria sequence
taggagatacaggaaataagtcaagtcaag

SEQ ID NO: 2633 - DNA, 256 bp, unidentified
  source 1..256: mol_type = unassigned DNA; note = Description of Unknown:Locusta migratoria sequence
taaaccagtggtgaatgcccgaaacgagcctttgggggatcaataaatgacatccaccatgcatcacctgaagggctcaactggatcacctgttggacttagaatctaagaacttgtgtaatgtgtacataatttaatataacactgtacatatgatcctgtacatatattgtccttgtcatacatatcttacaatgtatacaattagaactatgtacttgaaccaagctctgtatcatcattcgataaataataa

SEQ ID NO: 2634 - DNA, 805 bp, unidentified
  source 1..805: mol_type = unassigned DNA; note = Description of Unknown:Locusta migratoria sequence
tgaagattggtctccaagacagggatttcagactgcaactgacccgtaaggttctgggatttggacctcggaatgggctgccttgaacgaaccgaataagctgcgcgtagtcaagcccccacagccgtgtggagatcctccctgcgagcctctcgtagggagtctgtagtcctctgcagactacgtattggmcatacgtggttgacacacggccaccttctacgcgagaggacccaccaaattgccgttgtggtgcactattgacgtggtccacatcctggtggactgcccacttttagccgacttgaggcagtcttttaccctgccttctgagcttccattgattttatctgacgatgcctctatggttgaccgtgttttaggttttattcgcgcagctggcttttattggtctatttagtggtggggcctatttgcccgccttctcgggctcccacccctccagaacaataggccgttgtccttttacggtttatgacttgtttttcaattaaggattttagtgtgtgcagagtggctggctcatcctgtattatccttgtgatcagccagccacactcttctgctgtcctattttagttttctgtctatttggtcaactcctgtctgtcctctgttatatgtcgtcattttaccattgactgtctctctgtacccggagtatactggacgtggagtactatgcgacaaaagggaaacttttaaaagtgaactcttagctgggaacaggggactgataacccagcagtttagtcccctttaaacacccaacaacaacaacaac

SEQ ID NO: 2635 - DNA, 190 bp, unidentified
  source 1..190: mol_type = unassigned DNA; note = Description of Unknown:Locusta migratoria sequence
taagatgcaaatgtatgttgtcaattatcatcagcagtgatatgaacatgtaaatttactaaatataatattttatttgtctgtaagtgtagatgatgtacttaagattttatgtttgtattgtatacaaatatgatgacaacatccatacaatttttattgtatacggatggataaataaataaataaa

SEQ ID NO: 2636 - DNA, 488 bp, unidentified
  source 1..488: mol_type = unassigned DNA; note = Description of Unknown:Locusta migratoria sequence
tgaagtgacctgacgcggctccgaatcgggcactgcccattaacgcacaagtttttattgtcaagaagatcctcctttttgtgatgcctgtggcgtgcaacttacatagccacattttaatgagtgcatttatatcgtgctgcgagggcagaagccaatcttagtggtgatctgccctccattttagctgatgacgaggcgagtgtgaaaaggttttaagattttgtgaagcgtctgcactctggcctaagcttttaggttggagattttagtttgatgcgagtggctggctgagttcctccttgtgtgtcagccagccgtgctaatctacctagtcctctcttggtaactgtgatatgaatgtttttatggcctcatttaactagcttgtctcttatcttgtttgacactcgtctcactctgttttcgtccgggtgctaaagacctcgacgtctgcgccctgatccataatcaccaccacaccacca

SEQ ID NO: 2637 - DNA, 214 bp, unidentified
  source 1..214: mol_type = unassigned DNA; note = Description of Unknown:Locusta migratoria sequence
taacattacaattacctattgtacatgacatttatcctacattttagcttataaattttattactctctggacatggccagctttagccgaaaagtcttagccctacaaaatacatgttcatgtaatatctatgaagagcctaacaaacctatctatccgatgtctaatgtacgtataaagtttgatgcttctgacacgattaaataaaataaa

SEQ ID NO: 2638 - DNA, 178 bp, unidentified
  source 1..178: mol_type = unassigned DNA; note = Description of Unknown:Locusta migratoria sequence
tgattcaattgtactatatgttgtatttgtctatctctgtttttatagttttaaatctgtactttatattttatctctgtatttgactactgctttctgtaaaagcacttactttgtagtttaaattatgtgctggcttctttcagttacatttgtgatgtagttcgtacacgaataa

SEQ ID NO: 2639 - DNA, 75 bp, unidentified
  source 1..75: mol_type = unassigned DNA; note = Description of Unknown:Locusta migratoria sequence
taaaagtggttcgatgaaccctctgccatgcacttcaatgtgacttgcagagtatctatgtagatgtagatgtag

SEQ ID NO: 2640 - DNA, 554 bp, unidentified
  source 1..554: mol_type = unassigned DNA; note = Description of Unknown:Locusta migratoria sequence
taaagtacaatccatcctaccgtaatatacttccaaatatgcaacaaaacgcgataaattatagtagcaccgcaatattatccctatattacaatatagacacaaacaatttattacacttaaaatagttcggaatgaaattaaaatttattgtacgatatttgtatggtactgtttatgtcacactgcatataaccaacgatattgttacaaacaaaattaagcaaagaatatttaataaaaacatctttggatcaacagctctgtaaattacaccaaagtaattacaacaaacagcgtgacctaaacagtaaccaaatataaatgtatatatgaatgtaagtaattacaacttgtacagtcaatataacattgccatattaatgtattttcatgtaaaacacactttgttctctgtaataggtggcttagaaaatgggcaaagcccgaaactagtcgtcagcatttcaaataaaagcagctttggtgcatatataaaaatgtcttttctacaatatttaagagctgcaaaacgcgacatatcaaaaacattt

SEQ ID NO: 2641 - DNA, 128 bp, unidentified
  source 1..128: mol_type = unassigned DNA; note = Description of Unknown:Locusta migratoria sequence
tgagaatgtcctccgcagtcggggacgaaacgttgggtttcaataataaatccacaagaccacggcataatagcccggaaatttttagtaattttgaccattccggccgtgaaagtttacattttaca

SEQ ID NO: 2642 - DNA, 81 bp, unidentified
  source 1..81: mol_type = unassigned DNA; note = Description of Unknown:Locusta migratoria sequence
tgacagagatatgttttatcttattaattagacactagtatatcttactaaagtattatatgtagctgacattataccata

SEQ ID NO: 2643 - DNA, 176 bp, unidentified
  source 1..176: mol_type = unassigned DNA; note = Description of Unknown:Locusta migratoria sequence
tagacatgctaaaaactacttaataaatgtaatatagtaatgactcatttttgttgtgatgtgccatatatactatgtgtatatagaaatctgtatacttatgtaaaaaacctgtaagcaatatcctatatcaataatttgatgaagtggatgcttaaataaataaataaataaaa

SEQ ID NO: 2644 - DNA, 137 bp, unidentified
  source 1..137: mol_type = unassigned DNA; note = Description of Unknown:Locusta migratoria sequence
tagctcttccttttgttgtattttaccctatgtttttagctgttttcatataggcttattatccttcggtatatctcagttttgattcgggcgctaatgacctcagcagttgtgcgccctaaaaccacaaaaaaaaa

SEQ ID NO: 2645 - DNA, 270 bp, unidentified
  source 1..270: mol_type = unassigned DNA; note = Description of Unknown:Locusta migratoria sequence
tgatgttccttatatagctaatcaaaattgagaatataagttttgttgcaaacattgtactatatacctcataagtattccccctataaatattgtgctatgtatcccttgttttgttgtaaacattgtactatataccatacctacctcatagttcataagtattccccttataaatattatgctatgtatcccttgtaaccaactgacgtattcagaaaaatgatacttgtatcatttgatgttgaataaagtttatttatttattta

SEQ ID NO: 2646 - DNA, 175 bp, unidentified
  source 1..175: mol_type = unassigned DNA; note = Description of Unknown:Locusta migratoria sequence
taggagccgtacgcacaactaggatcaccaagacgacgcaaaccgcaaggacaatcaacaagccaggacacagaataccagcacccagttattttggaggcgtagctcaccagcttggactccaccgaccatcggaaactcatatgtttccgtcattgcacgagcgagcgagcga

SEQ ID NO: 2647 - DNA, 156 bp, unidentified
  source 1..156: mol_type = unassigned DNA; note = Description of Unknown:Locusta migratoria sequence
taaatgaagcaggacttaaatggcttaaatcactggacctggctctgtgacgggagatcctattcacacataatttttaatcccctgaacgcaagtactatgtactgtagtaacaatagtttaatatggtggctgacaagaaccatacgataataa

SEQ ID NO: 2648 - DNA, 203 bp, unidentified
  source 1..203: mol_type = unassigned DNA; note = Description of Unknown:Locusta migratoria sequence
tgactgacagcagcgccctctgttttgcctatatatacgacgcttactcgcgctctcgttgcagtacgccgctttacctccgaggatgccttccgcagacgagggcgaaacgtcaggggaaagtttcatgtatggaccacggcatctcagcccggaagctttaagtaatgacgacacctgccgtgaaagccttcattctatga

SEQ ID NO: 2649 - DNA, 59 bp, unidentified
  source 1..59: mol_type = unassigned DNA; note = Description of Unknown:Locusta migratoria sequence
taattgtatgtatatattcttgtatacttgtgaaaaccatacgataaataaataaataa

SEQ ID NO: 2650 - DNA, 23 bp, unidentified
  source 1..23: mol_type = unassigned DNA; note = Description of Unknown:Locusta migratoria sequence
tagcgccacaaaagaagaagaag

SEQ ID NO: 2651 - DNA, 29 bp, unidentified
  source 1..29: mol_type = unassigned DNA; note = Description of Unknown:Locusta migratoria sequence
tagttccggacacggaaagtaagtaagta

SEQ ID NO: 2652 - DNA, 214 bp, unidentified
  source 1..214: mol_type = unassigned DNA; note = Description of Unknown:Locusta migratoria sequence
taatttaaaggtgaactgatgtagtgctggaaacagagaagtggactgtgtcttttcactaaatttctaatacttaaataccacatgttatatttataaatgataaatttgtaaaattttctttctttcttatgttatataaaattaacaacatgacttgtgtctaatatcattgtaaatatgatctacagacaaataaattattattattatt

SEQ ID NO: 2653 - DNA, 66 bp, unidentified
  source 1..66: mol_type = unassigned DNA; note = Description of Unknown:Locusta migratoria sequence
tgacaagaagaggatcaacccatgacaagacctgccgcaaggcagaatacaattgatgatgatgat

SEQ ID NO: 2654 - DNA, 76 bp, unidentified
  source 1..76: mol_type = unassigned DNA; note = Description of Unknown:Locusta migratoria sequence
taaattttaaaatttattacatggactcaaactagatgtaaaggatggtgttctggacacgaaaaataaaataaat

SEQ ID NO: 2655 - DNA, 334 bp, unidentified
  source 1..334: mol_type = unassigned DNA; note = Description of Unknown:Locusta migratoria sequence
tgaacagcaacaggttaaccaaacagatttttaaatatctctgggacaagaagtcaacaatagctggattcaagaagttaggaaagatttggaaagaaacaatataagtgaaaaagatgcaacagaaagagaaacttttaagaagaaagtgttaaaaatggaaggattccaaggcaggagggagaagaagacaggagtaaagtggtctgaggagagaaaaaggatgcatagtgaaaagatgaaagaatactggaggaaaaagaaagaagaacaaaggaggaaacattgaaattggtgcgtggtccttagatggccgaaacgaagaaagaagaaa

SEQ ID NO: 2656 - DNA, 31 bp, unidentified
  source 1..31: mol_type = unassigned DNA; note = Description of Unknown:Locusta migratoria sequence
tgacatggattcggacacgaaaaagtaatgt

SEQ ID NO: 2657 - DNA, 477 bp, unidentified
  source 1..477: mol_type = unassigned DNA; note = Description of Unknown:Locusta migratoria sequence
taaatgaacaagttcaagcaatacatacagcttttttaaaaactttgtggacctattataacaaaagtcgtttattttaaatttcaacctctgtcttactgtgcaaatgatttcgtgacacctgaatgtacccactagcttgtggatgatctttggaatttagaggtctttgttttcatgtgcatacgtgcgccccactcgtgttgttgactccgtgcatttcgctagtgttatgcgccgccagtgctggggtctgtttgaatcctgacgaagcacagtatgctgaggacctttctgcgtagacacggttacaagggaagtaaccacgttttcttttattacgttttagatttttattgtctcaggttttaagattcttgtatagattatctgatgatgagggcttgacccttgaaacgcgtcatattttagtgtttttacacgatctctgtggttgagcctacttgacaaaataat

SEQ ID NO: 2658 - DNA, 363 bp, unidentified
  source 1..363: mol_type = unassigned DNA; note = Description of Unknown:Locusta migratoria sequence
taatgggaagcctgatatttcaggcacccaccattcaaacggttttaatcttttcgtcctgtcagtccactttgactggcagtttagtgtgtgcagaatggctggctcatcctatattatctttgcgatcagccagccacattcttctgctgtgatattttatgttgttgtctgtttggtcaactactttgtgttttcctttaaatgttgtctcttagcacgcattatcactctgaccgtctctgcattagacgtggagtactttttaccgctaattaaaagatgtgctctcttggctaggaacaagggactgataaccgttgctgtttagccccctttcaaaaacccaacaacaacaacaac

SEQ ID NO: 2659 - DNA, 243 bp, unidentified
  source 1..243: mol_type = unassigned DNA; note = Description of Unknown:Locusta migratoria sequence
tgatgtttattatcgatattctgaccggtttcatctttggtcgtgtcggcgctgtgtgcttgcttgctcggtgtgtgttgtctttcctgtttactcattgaaaaccgaggttttaaagatcgttgcacattgcttcctcactgcagtttcgccttgaaaatggcagggtggtctcctgccgaaatatcggccgtcgtcgattttggtacctggcagcatacccgtaagtttttcgaagttgtt

SEQ ID NO: 2660 - DNA, 314 bp, unidentified
  source 1..314: mol_type = unassigned DNA; note = Description of Unknown:Locusta migratoria sequence
tagaaatgtaggtctatgataaagtgtgtagagaaaatgtaaatttactattagttattacgatgtatttatttatataaaaaatgtaatcatgctgtgtaaaagtggcaaatatccattttattcaatatgtagagtaacaaaaattctagcagtgaaaaacattatgtggtaaatcgtaccaagtaaaatgttaatctacttttaatattacaacacaagaaaagaaatatgttaggccagaaatggtccaatatctattgtaccctgtacagttctggattcacaggaccaataaataaataaataaataa

SEQ ID NO: 2661 - DNA, 81 bp, unidentified
  source 1..81: mol_type = unassigned DNA; note = Description of Unknown:Locusta migratoria sequence
tgaggatggcgggcagttgcgccgctgaaatattgtgtcaagttgactttagtatccggctgcaaacccgagaagattaca

SEQ ID NO: 2662 - DNA, 246 bp, unidentified
  source 1..246: mol_type = unassigned DNA; note = Description of Unknown:Locusta migratoria sequence
taattcataatatttatgttggccataaaagtaataaataaaaaaaataaataacctctgtattattaaattgtcatgtttatttttgaactaaattgtattaatgcataacaacaaattgtaataacctctgtattattaaattgtcatgttattattttgaactaaatttgttaacaacaaattgtaataacctttgtaatattgactaaagtggtccaatgaaggccataaaataaataaata

SEQ ID NO: 2663 - DNA, 114 bp, unidentified
  source 1..114: mol_type = unassigned DNA; note = Description of Unknown:Locusta migratoria sequence
tgattttataactacattgtatgtatatattattattttaaactgacgagtctcctgtacactaaatcaatgatttaacttgtatgttatgagacaataaaattctgattctga

SEQ ID NO: 2664 - DNA, 27 bp, unidentified
  source 1..27: mol_type = unassigned DNA; note = Description of Unknown:Locusta migratoria sequence
tgaccgaccggacacggaaatgaatga

SEQ ID NO: 2665 - DNA, 84 bp, unidentified
  source 1..84: mol_type = unassigned DNA; note = Description of Unknown:Locusta migratoria sequence
tagaaacctttctttacatctgcataatttttctttttaaattaatatgtaggtattttatgatgtctctgacacgaataagaa

SEQ ID NO: 2666 - DNA, 335 bp, unidentified
  source 1..335: mol_type = unassigned DNA; note = Description of Unknown:Locusta migratoria sequence
taataataaattacaaataaaaagtgttgtttattttataactatgtacacagtatggtactataactttgttactgtcttgaacacattgtaatacatctgtatgtttattgtctgatatctatttatggtagtgtacatatctgataactataatgtaattgtttattattcttgacattcatttcatattattttcttctatcttatgggattttctaagtcatttattgttgctattttgttttatcattattactattttatctaaccttgacgacaccgattgcatgtaaaaatgctcaaaggtgaataaagcatctaatctaatctta

SEQ ID NO: 2667 - DNA, 59 bp, unidentified
  source 1..59: mol_type = unassigned DNA; note = Description of Unknown:Locusta migratoria sequence
taatctaatataggtgctggaaaaatgtactgacattgtaaaaccagaataataaataa

SEQ ID NO: 2668 - DNA, 59 bp, unidentified
  source 1..59: mol_type = unassigned DNA; note = Description of Unknown:Locusta migratoria sequence
taattactcaagttcaatcgctctctttaaagggaataatcgaaataataataataata

SEQ ID NO: 2669 - DNA, 231 bp, unidentified
  source 1..231: mol_type = unassigned DNA; note = Description of Unknown:Locusta migratoria sequence
tagtattaatcctattagagttaagtcaataccttttatttacatccttttacatgtaatcaacctgtataaattatgttattaactgtttatctgtaaaaatcattgttatgttataggtaactcacatgtaaagaaatactgtatgtgtaaaaccctggtccgatgtaagagagggcctgatggccctaatctgatcaggctaaataaacaaataaataaataaataaa

SEQ ID NO: 2670 - DNA, 72 bp, unidentified
  source 1..72: mol_type = unassigned DNA; note = Description of Unknown:Locusta migratoria sequence
tagtggtactcaaggtaccctccgccacacaccgtcgggtggcttgcggagtatggtgtagatgtagagatg

SEQ ID NO: 2671 - DNA, 96 bp, unidentified
  source 1..96: mol_type = unassigned DNA; note = Description of Unknown:Locusta migratoria sequence
taattctgtatatatgctgtatatttctatacatttgtaacttgactttgtcaattgctgtaacagctaaacaataaaatttcatttatttattta

SEQ ID NO: 2672 - DNA, 263 bp, unidentified
  source 1..263: mol_type = unassigned DNA; note = Description of Unknown:Locusta migratoria sequence
tgactggctcatccattattatcctagtgatcagccagccacatcttctgctgtgatttttagcacagttgactatttggtccactacttttgtggtttcccttttccttttatatgtcatttagcacacactgccttcctgtacttctcgtgtactggctgtggagtgcttcgtcttcaactgtaaatcacatgtgtgatctctttgctgggaacaggggactgataacccagccgtttagtcccctttaaaaacaacaaca

SEQ ID NO: 2673 - DNA, 16 bp, unidentified
  source 1..16: mol_type = unassigned DNA; note = Description of Unknown:Locusta migratoria sequence
taaagtaaagtaagta

SEQ ID NO: 2674 - DNA, 242 bp, unidentified
  source 1..242: mol_type = unassigned DNA; note = Description of Unknown:Locusta migratoria sequence
taattttgtacataatgttaatacattctagtgaatttgtgaaaagtgacatttgattgttatatacatgtcttacacatgacataacttgtattaaattaaatatgtatatgtttgctcttgcacattaggagataagtgaaaatgaatatataatgctattgacgtatcctatattacacgtacatgtattgtacacaatgtaatcctacaggatcaaataaaaattcaattcaattcaa

SEQ ID NO: 2675 - DNA, 255 bp, unidentified
  source 1..255: mol_type = unassigned DNA; note = Description of Unknown:Locusta migratoria sequence
tagcagaaactagcagcgtcctacagaattagtcacctctttccatattttatgtttctagtttgtaatttgtgtattttaattgtatatttattgaattttgcattcttggattgtaatttgctcaatgtaattgtacattgtaaacatatatttagtgaatttggtgtccctagattgtaaattgtttattataattgtatatttattgatcgaaagatatgtcttagtcctgcacacgtaaataaataaaaa

SEQ ID NO: 2676 - DNA, 430 bp, unidentified
  source 1..430: mol_type = unassigned DNA; note = Description of Unknown:Locusta migratoria sequence
taagattttattgctgacgcttggacaggatgggtgggtttgtggccctccctgcgagcagcagggtttggagctctcccctcccctccccctgacgacttccatttctccttttaacttggttttaattcacgttgtttccccctttttacatttttaggcttctcatttaggagcatacactgttctcctgtatctgcttgtcattaattaacggggattctagatttgtcgcgacgttccttgcagaatcccgctttttctattggttttagtcctgttctacttgattttaacccccttttagttcctctattttactctcgtcacggtcttagccgaccacaccctggcttgcactccatacagaggtcatgggactgatgacctagctgtttggtcccatccacccatcaaccaaccaaccaac

SEQ ID NO: 2677 - DNA, 57 bp, unidentified
  source 1..57: mol_type = unassigned DNA; note = Description of Unknown:Locusta migratoria sequence
tgagggaagttgtgtaaacgtaacccatagatggctgtaacgaaaataaataaaaaa

SEQ ID NO: 2678 - DNA, 152 bp, unidentified
  source 1..152: mol_type = unassigned DNA; note = Description of Unknown:Locusta migratoria sequence
tgagcctgctatggacaataatgacgtatatgtgtgaaaatcatgagtatatatgaatgtataattagtacttagtttttatttgtaatctagtatatgtagcctattaattaactacagatgtagctcagacacgattaaataaaaataaa

SEQ ID NO: 2679 - DNA, 795 bp, unidentified
  source 1..795: mol_type = unassigned DNA; note = Description of Unknown:Locusta migratoria sequence
taatttccactgtctgtgaccgagacaccactaaaactgcctattttagttactttcatgcataatgttgtatggcatagttttctggggaatcagccactttccaaaaaaaatattcattgcacaaaagagagcgatcaggataatgagcggagtccaacctagacattctgtagaaacctttttagaaaattggggatctgacaactgcatgtcaatatatctactccctactgtgctttattgtcaaaaatgtgcacttgtacaaaactaatgatgttaccatactcacaataccaggaggaagctagatctccattatgaattaaaaaacctaatactgtacaaaaaggagtccactatatgagctgcaaagtgttcaatgctcttccactatcctgaaatcacttgtccatgagcctcccaaatttaaacaacagctcaaacaatatctatagataagtccttttattcagttgaagaatatttcaatttgtgttaacaatttattttttaatttacaagatgttatttttggtagcatgtattgtaattttgtcaatatactattcttgctgtgagatctaccttttttatgtaattttattcttttaattttttgtgtaatgtaatttttgtaattttaatgtgtaatttttgtctatacctttaatgtgtaatttgtctattgcaagagggattctgtatgttccttttgtaacaatttgacacgtcctacatccagtgaatgtctcgctgtattggatccatgggattaaataaataaataaataa

SEQ ID NO: 2680 - DNA, 248 bp, unidentified
  source 1..248: mol_type = unassigned DNA; note = Description of Unknown:Locusta migratoria sequence
taatgtaaacaccaatcctggacttccttttccaccaataggaagaaataaagcaaacaccaatgataagagagctgaaaccaccaatcataactggcaacatttaatatttaagacaccagctttccctcatccagcagtaaacgtaacacccagaagatggccgcttgcaatagtggccgaaacgtcggtgaaatatttgatatattgacgatgcggtccaatacccagaagagttttatcaacaa

SEQ ID NO: 2681 - DNA, 71 bp, unidentified
  source 1..71: mol_type = unassigned DNA; note = Description of Unknown:Locusta migratoria sequence
tgaaagtggttaatgaaccctctgccaggcacttaaatgtgatttgcagagtatctatgtagatgtagatg

SEQ ID NO: 2682 - DNA, 202 bp, unidentified
  source 1..202: mol_type = unassigned DNA; note = Description of Unknown:Locusta migratoria sequence
taatgtgacaatcaaaatttaatttataacctacactcttttattgtacatatttatgttaaaaagctaatcatgtaacaatatatattttaatatgtaacatttatatatgttaacttttgtaccataatgtatgcaatgacgatgccttatacaacatcacagttgtccacaggcaaaataaatcaatttcaatttcaat

SEQ ID NO: 2683 - DNA, 393 bp, unidentified
  source 1..393: mol_type = unassigned DNA; note = Description of Unknown:Locusta migratoria sequence
taaaagaatccgttgaaatacgcattgcggaaaatctgatgaaccgtgacagcggctaccagctgaataatgcgtggaatcccgtcatctccgagatttgttctagacgaagacgccagaagactccgataactgcggcagcggcactatcgaagacagctgatccttgcagttccaccagcgagggcgctgccgccgggcggtgtggtccttctgtcaccgtgtcttcgacgcatgcgcggtaataccaccagcgcgctatataaggcggagcggagagcgtcttcgtcagtccttgttggctcacctgaagatgactggcaggtgtccagttgaaatatcgtggaatgaagtttacgacgaccggctgcaaacccgaaatctttttgaaca

SEQ ID NO: 2684 - DNA, 111 bp, unidentified
  source 1..111: mol_type = unassigned DNA; note = Description of Unknown:Locusta migratoria sequence
taatatttctgtctgtttatagttcgtagtttacatgtatgtaagtaatctctgtatgttatacctttataaacttctgtacacatgatgcttctgacacgaataaaaaaa

SEQ ID NO: 2685 - DNA, 15 bp, unidentified
  source 1..15: mol_type = unassigned DNA; note = Description of Unknown:Locusta migratoria sequence
tgatgatgatgatga

SEQ ID NO: 2686 - DNA, 85 bp, unidentified
  source 1..85: mol_type = unassigned DNA; note = Description of Unknown:Locusta migratoria sequence
tgatgatgatggcacgttacgctatcgaaaattcgttccacaacgatcaatccatccggctgcacgcccgagagatcttcactca

SEQ ID NO: 2687 - DNA, 677 bp, unidentified
  source 1..677: mol_type = unassigned DNA; note = Description of Unknown:Locusta migratoria sequence
taaaacacacacacacacacactaaaacgaaagcaacatgattcaaaactcccgcccccaccacagtcagctgttcttaacactactcccagaattcaactgcccaccatcttgttttcataacataaacattgagtgaaagtgaaagtgacacagtgcctgtccacaacacgaaaacagcgcatatccaccaaagtaagtgacaaaaacttgttataaacacatagacattttgttatagaagcagtagctacagtaaaatcaaaccaaaacacaaaaactacgtcctgtattttcgtaaaaatcccgatatttacaagctaaccattcaccccattaaatacacacgttttggtttgcagatgacaaactgtcaaaaactmtcagtgacgttttgtgagttgaagaaccacaaacacaacacatgtggtattaaggtaggcctagcatacctataaaaataagaaacgatttatattagtctcacaattatctgtagttttcacagttaatgtacaaaaagtaacaatcattccattgttaatttgacagacaataaacatcccactgatgatgctgcaacgccagcgaaacatgtatgggagaaactaaaaaacatttgtgtttgctcaaggcggaccatacctataaagcaaatttatttgtaagcaaacacg

SEQ ID NO: 2688 - DNA, 187 bp, unidentified
  source 1..187: mol_type = unassigned DNA; note = Description of Unknown:Locusta migratoria sequence
taaaaaattcaggcatttgcaggatttgaggacagaactagaccgagaacgaaatcatcgtggacagaagagcgaagaaagatgcaaagtatgagaatgaaagaatactggaagaggaggaagaacggaagaaaggaagctgatgtgaattaacgtggtccaaagatggccgaaacgaaagaagaag

SEQ ID NO: 2689 - DNA, 166 bp, unidentified
  source 1..166: mol_type = unassigned DNA; note = Description of Unknown:Locusta migratoria sequence
tagttgcccacccattctacaatttagaagaatttctcaactgtaatataatattgtaatattactgacaagctgttatctcttttaaattaacaatttatgttatctatgtgacgttgtctattgctgtaatggcctaatgacaataaaattaattattattatt

SEQ ID NO: 2690 - DNA, 28 bp, unidentified
  source 1..28: mol_type = unassigned DNA; note = Description of Unknown:Locusta migratoria sequence
tgatctggacacggaaatgaatgaatga

SEQ ID NO: 2691 - DNA, 390 bp, unidentified
  source 1..390: mol_type = unassigned DNA; note = Description of Unknown:Locusta migratoria sequence
taatggtgggttcgtatgcctgatcttcaggcatacaccgcttatagttttaatctgttgtcacttttgtcttgtcagtcctatttccgactggcagttttagtatgtgcagaatggctggctcatccattattatcctagtgatcagccagccaacaacatctgctgtgattttwagcatagttgattatttgttccacctctattgtggtttcctttttctttttatgttgtaattttcgcccacactgtcttcctgtacatcttgtgtactggttgcggggtgcttatttttaaccgtaaatgaaatactgtgatctcttagctgggaacaggggactgatgacccagtagtttagtcccctttaaacacccaacaccaaccaacca

SEQ ID NO: 2692 - DNA, 298 bp, Lottia gigantea
  source 1..298: mol_type = unassigned DNA
tgacccccctctctattttctagctcattaagtataatatattctaatccttatatatagatgtttatcttttcagaacctatwaatactcttttcttttagaactggtaacaagaaaactttcatattatagacttttgtttattgtagattactcgtggttgtttttttaacttaatactaactatgctaacttcaccttatcttgtattgaacatttatctctttatttgtgaccttggccagtgctttacatagaagtttttaggaacttcttcactcttaacaccaataacca

SEQ ID NO: 2693 - DNA, 98 bp, Medicago truncatula
  source 1..98: mol_type = unassigned DNA
tgagttggatccaaatttggtgtatgatagaacactatggcgtcatttgatccatgtagccgaccccacttagtgggataaggcttggttgttgttgt

SEQ ID NO: 2694 - DNA, 41 bp, Melopsittacus undulatus
  source 1..41: mol_type = unassigned DNA
taaaacccttcccaaatcttcgttcgcgaagtcaagccatg

SEQ ID NO: 2695 - DNA, 18 bp, unidentified
  source 1..18: mol_type = unassigned DNA; note = Description of Unknown:Mesobuthus martensii sequence
tgattatgatgatgatga

SEQ ID NO: 2696 - DNA, 33 bp, unidentified
  source 1..33: mol_type = unassigned DNA; note = Description of Unknown:Mesobuthus martensii sequence
tagaaatgggaaggagcttgatgatgatgatga

SEQ ID NO: 2697 - DNA, 39 bp, unidentified
  source 1..39: mol_type = unassigned DNA; note = Description of Unknown:Mesobuthus martensii sequence
tagccccaacggttacccaaccatgggaagatgaatgaa

SEQ ID NO: 2698 - DNA, 29 bp, unidentified
  source 1..29: mol_type = unassigned DNA; note = Description of Unknown:Mesobuthus martensii sequence
tgaaataagaaatctgatgatgatgatga

SEQ ID NO: 2699 - DNA, 16 bp, unidentified
  source 1..16: mol_type = unassigned DNA; note = Description of Unknown:Mesobuthus martensii sequence
taggattggattggat

SEQ ID NO: 2700 - DNA, 222 bp, unidentified
  source 1..222: mol_type = unassigned DNA; note = Description of Unknown:Mesobuthus martensii sequence
tagccatcattgtggtgggaaaatttcccaggactgtatctgaggtccttcagacagctctcaatacagtctctaagtggtgtgatagggttggattgtctgttaatccagctaagactgtcattgtaccttttacacgaagaagacaattggcggggctaattgaaccatcattcttcggcaaaaggttgcagttttctacccaggtcaaataccttggtg

SEQ ID NO: 2701 - DNA, 1497 bp, unidentified
  source 1..1497: mol_type = unassigned DNA; note = Description of Unknown:Nasonia vitripennis sequence
  misc_difference 70: note = a, c, t, g, unknown or other
taaaagaaaatataatacaaatagagaaaagagcaaacgaaagaacgwaaagagcaatcgaaaggaaacnagagcaatagagaagaggaaaggaaaaaacaaayaaggaaagawagaaagaaccagacgaaggaackaaatagagcgcagggacatttagagagcaggggagacgacggaacaggaggaacagtggatgaaacaaaagtcactaggwawggacaagaaaacgatacaggtggaragaggaacgtggacgagacagaaaagaaaacacgtggtgagccacagatagaaaagaggttagtaaagataaaacaagtagtgaaaggagaagataaaaaagtgaaaaggagaagatgtacggagacaagaagaaagaaagagagatgagggaactgagagaggaggtrgaaggatggaagataaaggcgaggtttgagagagaaaaaagagaagccctggaaaagaaaatgcaggatgtgagagaggacgtggagtttttaaaggggaagatgaaaaacatgcagaaagagatagatgagatgagagaagggcttgcaggtaagaaaaatagagtggagacggtaaagaaaaggcaggagatgagaagagggagaagagtaataggagaagagagaattttgagagagagaaaggctgatgcggccagtacagatataggaaaggggacagcaggtgcaaggtgtgggaaagaggcctgatagtacacctaaacaattggacggaggaggattctataaaagactggctggaggatataatggaaggagtggaatgggagatggaagatacaaggacggaggacacgaaaaaggtaatttttaagagaaargaagacatggaattgatatgggagaagagggcggaaataagagaaggaggcaaaatcaggctggagcagtggctatcmttcgatgagagaagggccaaagcgctgattatgagagagaaaaggagaagagaagaggatgagatcgaggagggcgaggtctcgcacaaaaaagaatgggtagctgaaatagaaggcgaactgtacaagtgggacgaaaagaaggagagaattgtaaaaaaaggaaaagggatagaackgggagaagaggrcagatataagaaatggaggtcgggggagtcagaggaggaagaggaagawtatcagacaaagatggagagaaaggaagagtagagtttactcacaaacacacataaacacacacaaacaatcaaacacacacacacacgtacgacttatacacacgcacacacacacacatgcacaaacrgacacgaaaacargaaaagmaggagarcrcacayacacayacacacatrtacacasgaacattacctacagagacacacataacacaccagattaggttaaagtaggattaaagcaagaggtatgtaaatatacgaatgaataaatattgtaaacacgaatagtgaaatacaataaagttattattattatta

SEQ ID NO: 2702 - DNA, 183 bp, unidentified
  source 1..183: mol_type = unassigned DNA; note = Description of Unknown:Nasonia vitripennis sequence
ctcgtacacactccacgcacacgcacacacctactttctcgctcattccaccttcactatcgccayactytcacactatacatactctaaacatacctcaatctattgttatttcttttcttactttgtaatgctgtaaacttacaatcgtacaatataatgtacgcaaaataaaactaatct

SEQ ID NO: 2703 - DNA, 91 bp, unidentified
  source 1..91: mol_type = unassigned DNA; note = Description of Unknown:Nasonia vitripennis sequence
gggatgtcatgacgaagggtggtacaatgggtttacagcctaagtgccagggatctcggaggtccccccttcatagtaataataataataa

SEQ ID NO: 2704 - protein, 29 aa, Betaretrovirus sp.
PMGALQPGLPSPVAIPLNYHKIVIDLKDC

SEQ ID NO: 2705 - DNA, 31 bp, Nelumbo nucifera
  source 1..31: mol_type = unassigned DNA
taatgaaagttaccgtttcctataaaaaaaa

SEQ ID NO: 2706 - DNA, 142 bp, Nelumbo nucifera
  source 1..142: mol_type = unassigned DNA
taacttaactgtttcttttttccttttctctcttttgagggtttaagttgtattcggaagataagagtgtttgtcttccttgctgtaattattcttgtgatgtttcaatgaatttaatgaatctgttattgatcaaaaaaaa

SEQ ID NO: 2707 - DNA, 45 bp, Nelumbo nucifera
  source 1..45: mol_type = unassigned DNA
tagtttcatatctttaataaagtttcttgttattgatcaaaaaaa

SEQ ID NO: 2708 - DNA, 839 bp, Nelumbo nucifera
  source 1..839: mol_type = unassigned DNA
tgaatgtgcagagtttattcaggttcatgccgagtgggccaacaaaaagggccaaggctatgtggagatgtatgagggctgcagtatgctggactgtttgggaggagaggaactcacggatattctcagaaaaggagagaaccttggaagtaatattggaggtaatccatattagggtgatacattggctgaaaactttggccttgtttgcagacttctcagtagatgagatggtaaaaaactggaaggaaattgcagaattagcctcagctaagaaggcatcactctcttgctggagtcccccacctaatggctttmttaaactgaattttgatggcagcagtatgggtaatccaggtccatctggaatagggggagcaataagagatgaacatggaaatctgttagctatgttttcaggaccaattggggaaggagactccttgagggctgagattcttgcagcccttgaaggggttcgaagagccaaggagatgcaaattagaaagctgatcattgaaggagattctgaagtggtggtgaactggttaaaagaggataactcaaggatatggaagtacagcaatgaaaaacgaaaatttaagtggctggctaaggatgttgaaattcagtacaaatgggttaagagaagtgcaaactcactggcagatggtttagctaggcaaggggttaatagaaactctttgttttgggctttattgtaattgtatttgctgctcatagactgtttagggagctaagattgtttagcccccttgctttgtaattcttcttaattttaatgaatacatttcacagttattgataaaaaaaaaaaa

SEQ ID NO: 2709 - DNA, 11 bp, Nematostella vectensis
  source 1..11: mol_type = unassigned DNA
taacaggtaac

SEQ ID NO: 2710 - DNA, 497 bp, Nematostella vectensis
  source 1..497: mol_type = unassigned DNA
taataatacctattgatatatatatgcatgaaaagatatatttatttttatttaacatttacattaacaattaacatattttttactagtttctgatctttagggtgcatgccatggatgcatggagcggctgccaaactagcgggagttggctcaagggtgaggcaaagattctttgtttcgcgcttgggttgattcttgttggttggctgtttcatgcatttatggcattcactctattgatgataattttaatttcatgtatatataattaattatttaattttatcaaatatctaatttcaataattttcaagtaatatatatttatgcttcattttcaatttaacctaaattatttttccgatggccgataattattattattatatttttcttttgtatttacatattgtattttctttttcaactcctagtatagtcttaactgttttttaggagtataactattaaagattaaagattaaagattaaag

SEQ ID NO: 2711 - DNA, 139 bp, Nematostella vectensis
  source 1..139: mol_type = unassigned DNA
taatagtataacgctatatgtgctggccctttgccttaattcagtctgtaatactgccatggcaattgaataaaacccctatctatctatctatctatctatctatctatctatctatctatctatctatctatctatc

SEQ ID NO: 2712 - DNA, 38 bp, Nicotiana sylvestris
  source 1..38: mol_type = unassigned DNA
taatattaatatatgtttatcttttaaaccaaaaaaaa

SEQ ID NO: 2713 - DNA, 1446 bp, unidentified
  source 1..1446: mol_type = unassigned DNA; note = Description of Unknown:Notamacropus eugenii sequence
cttggtactggctaagaaatagaatggtagatcagtggaataggttaggtacacagaagtcaatgacyatagtaatctactgtttgataaacccaaggaccccagcttctgggataagaactcactatttgacaaaaactgctgggaaaactggaaaacagtatggcagaaactaggcatagaccaatacctgacaccatataccaaaataaggtccaaatgggtacatgatctagatataaagggtgatactataaacaaattaggggagcaaggaatagtttacttgtcagatctatggagaagggaagaatttatgaccaaacaagagatagagaacattatgaaatgcaaaatggataattttgattacattaaattgaaaaggttttgcacaaacaaaaccaatgcaaccaagattagaaggaaagcagaaaactgggaaagaatttttacagcaagtgtctctgataaaggcctcatttctaaaatatatagagaactgagtcaaatttacaagaatataagtcattccccaattgataaatggtcaaaggatatgaacaggcagttttcagaggaagaaattaaagctatctatagtcataaaaaaaatgctctaaatcactattgattagagagatgcaaattaaaacaactctgaggtaccacatcacacctatcagattggctaacatgacaaaacaggaaaatgataaatgttggagaagatgtgggaaagttggaacacctaattcattgttggtggagctgtgaactgatccaaccattctggagagcaatttggaactatgcccaaagggctataaaaatgtgcataccctttgatccagcaatactacttctaggttgtatcccaaagagatcataaaaatgggaaaaggacccacatgtacaaaaatatttatagcagctctttttgtggtggcaaagaactggaaattgaggggatgtccatcaattggggaatggctgaacaaattgtggtatatgaatgtaatggaatattattgtgctataagaaatgatgaacaggtagacttcagaaaaacctggaaagacttacatgaactgatgctgagtgaagtgagcagaaccaggagaacattgtacacagtaacagcmacagtgtgtgakgactrtttttgatagacttagctcttctcagcaatgcaakgatccaaaacatttccaaaggactcatgatgcaaaatgctatccacatccagagaaaaactgtggaatckgaatgcagatgaagcagacttttttttttattctgtgtcttcttttacaacatgactaatatggaaatatgttttacatgattgcacatgtataacctatatcaaattgcttaccatcttagggaggggggaggggagggagggagaaaaatttggaactcaaaattttaaataaaaa

SEQ ID NO: 2714 - DNA, 451 bp, unidentified
  source 1..451: mol_type = unassigned DNA; note = Description of Unknown:Notamacropus eugenii sequence
tgatgggctggccacgttgttcgaatgcaaaatgtatgcttgccaaaaagactattttatggagaactcgcatggggcaggtgatcacatggtggtcagaagaaacaatacaaggacactctcaaggtctctctcaagaactttggatttgactgtgcaacatgggagacactggcacaggaccactcagcatggtgtgcccacatcagaaaaggtgctgtactctatgagcaaagcagaattgagatagcacaaagtaaacacaggatgtgcaaatttggaatatccaccccaaatattcatatggactatctgtgcccaacctgtggtagagcattctgagctcatattggtctgatcagccacagtcggacacactgaaatttcactttatcatggtgatgtcattttggtcctctttgaagatgaaggacaacaaccaacctattat

SEQ ID NO: 2715 - DNA, 189 bp, Oryzias latipes
  source 1..189: mol_type = unassigned DNA
tgagttgatgtttttattggttttatttttttattggttttattatttttatttaatgtatcgatttttattgattttattctgttttagtttgttgttttgtttttattctgcgttgttaagcactttggtcagcttctgctgttttaaaagcgctttataaataaagttgacttgacttgacttgac

SEQ ID NO: 2716 - DNA, 37 bp, Papilio sp.
  source 1..37: mol_type = unassigned DNA
taagggataagggcaagtggatgatgatgattgtaga

SEQ ID NO: 2717 - DNA, 18 bp, Papilio sp.
  source 1..18: mol_type = unassigned DNA
tgacaatgatgatgatga

SEQ ID NO: 2718 - DNA, 29 bp, Papilio sp.
  source 1..29: mol_type = unassigned DNA
taaggagatgatgatgatgatgatgtatg

SEQ ID NO: 2719 - DNA, 128 bp, Papilio sp.
  source 1..128: mol_type = unassigned DNA
tgaaaatgtacatacatactttattaaaaaaaaaactttttatatttaactttaactatttatattgttattaataagttgtaaatattgtaaattgtcagcgaataaaggctttatctatctatcta

SEQ ID NO: 2720 - DNA, 49 bp, Parhyale hawaiensis
  source 1..49: mol_type = unassigned DNA
taacgccgcctggacctcgtccgaagtatcatcaaaggtatcaaaggta

SEQ ID NO: 2721 - DNA, 198 bp, Parhyale hawaiensis
  source 1..198: mol_type = unassigned DNA
tgatggctctgtctttgctggtgcgggtattggcagctttaaacgatctgtacacagagctattctgtgatctcggatcttcttttttttcattcttttgttttcttcacccgctgggctggttgcgtgggggtttgttaacctcatggagtttctccgttcccacgtcgccagtctggtgtgatttaataataataa

SEQ ID NO: 2722 - DNA, 96 bp, Parhyale hawaiensis
  source 1..96: mol_type = unassigned DNA
taatggcaatagctcatagagggccggggcgtaagttccggtgtctctttgggaatgggcctattggttcgtctactgccgcctatctaatctaat

SEQ ID NO: 2723 - DNA, 17 bp, Parhyale hawaiensis
  source 1..17: mol_type = unassigned DNA
taactacaacaacaaca

SEQ ID NO: 2724 - DNA, 526 bp, Pelodiscus sinensis
  source 1..526: mol_type = unassigned DNA
tagatgggattggtcctgcctagagcggagggctggacttgacgaccttctgaggtctcttccagttctatgattctatgataaggggatggttggatgaaataacatgatcttggtaactaattgaccattcatttccagttggaaataggtcaatggagggatgataggagttgctatagggaactttctgggtgtctggctggtgagtcttgcccacatgctcagggtttagctgatcgccatatttggggtcaggaaggaattttcctccagggtagattggcagaggccctggaggtttttcgccttcctctgtagcattgggcacagatcacagctgaaggactctctgcatgttggggccttcaaagtatttgaaggcttcaatatctgagacataggtgagaggattattctaagaggggtgggcgagattctgtggcctgcactgtgcagggggtcagactagatgatcataatggtcccttctgaccttaaagtctatgagtctatgagtctatga

SEQ ID NO: 2725 - DNA, 11 bp, Pelodiscus sinensis
  source 1..11: mol_type = unassigned DNA
tgatccttcgg

SEQ ID NO: 2726 - DNA, 182 bp, Pelodiscus sinensis
  source 1..182: mol_type = unassigned DNA
tgagtctgtgtgtgtgtgttcctcctctcgagatgtttttagcaggttttatgtccctctgggtctcttttggggtctcgtattttaaatttttatatatatttgtattgtgtttttaaaaattttgtaagccgcctcgaatattttaaatagagaggcggggtaaaaatattttaaataaa

SEQ ID NO: 2727 - DNA, 381 bp, Petromyzon marinus
  source 1..381: mol_type = unassigned DNA
tagctgccttataattgtacagccatttccatttcttccagtgggttgtactcgctctcgtgcagtgcaccaccgcttcccccgaaccccctgcagcataacaaaaggcggcttaacttagccccccccccccacccacgtcccttcctggctcctcccccccccccttaacctgtatataatctcgggtgtctcagagctcttcacttgatacagctattttgctgtgactgttccacctgaagacggaagcttgtgttgcctccgaaacgtcgtgatttaatttagttgttttcatttattttattttacctacgtgactttaccgaaaaaaaccaaagagtatgaatccttgcagtcacgaaagcttcaaatctagaa

SEQ ID NO: 2728 - DNA, 432 bp, Petromyzon marinus
  source 1..432: mol_type = unassigned DNA
taacctgctgtgatgtttccatccttcctgcgattttagctgactctctgagttgcattattaggttggatgtctttgtattgacgggctggatgtccttctcgctcagtcaccgatgctgcgacatactaggcaagtcaccgatgctgcggcatactaagctcgtgcattgacatgctaatctctcacaatacaatagccacttccacagcctcagggagaccatctctagccccgccctcttaccctgaggctgcacccatctcaggcctacataagaccttgtttcagtagctttctctctctcacctgaagacggtcgcttgtgttgcgatcgaaacgtcgtgatctattaattttctatctacgtgactttaccgaaagaaccaaagagtatggattcctgcagtcacgaaagcttcaaatcaagat

SEQ ID NO: 2729 - DNA, 618 bp, Petromyzon marinus
  source 1..618: mol_type = unassigned DNA
taactggctgtgatgcttccatcctacctgccgatgttagcagttatttccgactctctgagttacattaccttgttaaatgtctttacattaacaggctaaatgtctcactaacatagctgctgctcccttttcctcgatgcggcggtggcgctcgttgtttaataggctgaatgtctctcattaacacagccgctgctgcgggagccgtctcacattgacatgctaatctctaatctcgagcaatacaatggcttcttcagcaccgtagccgtggggttacattaacagattgacatgctaatctctagcaatacaatggccgaggtatacctagctctgcgatcttacatttacttgcaaattccatctctagccccgcccacttacccttgggttgtacccatctcaaacctatataacctctggctgcagtagctctctcgctatatttcttcctgcctcagcagtccgcctgctgtattttttcacctgaagacgattgcttgtgttgcgatcgaaacgtcgtgattttattttattatttttctatctacgtgactttaccgaaagacccaaagagtatgaattcctgcagtcacgaaagctttaagtcaa

SEQ ID NO: 2730 - DNA, 249 bp, Petromyzon marinus
  source 1..249: mol_type = unassigned DNA
taattattaagtaatactgtttacaattgactgtaaaatagggatgtgcaatgacaaaatgtacctttatgtgggtatgtgggtatacttgggcagtttttatatataaaatttattgattatctttttttattttatttttatttcttgttttatttatttaaatttatgaatgatgcactgactggtgagcactttaaatttcgttgtactggtgacaatgacaataaaggatctatctatctatct

SEQ ID NO: 2731 - DNA, 496 bp, Petromyzon marinus
  source 1..496: mol_type = unassigned DNA
taactgactgtgatgtttccatcctacctgcctatgtcagctgttatttccgactctctgtgtgtctttctctctctctctgtgcatctctctccgatctctactccagtgacccgggtgctgccgcggggtccactttctgccccccccccccccccccttctctctccccccctgcagccgatctctccagtgctgccgcggtggtccactttactccagtgacccgggtgctgctgcggggtccactttctgccccgcctcctcccccccccttctctcctccccccctactgccgaggcctatataacctcgtgccacggcagatctctcgcctacttcagcagttttttcttgctgtggttgtcccacctgatgacgattgcttgtgttgcgatcgaaacgtcgtgatctattatttttctacctacgtgactttaccgaaagaaccaaagagtatggattcctgcagtcacgaaagcttcaaatcaagat

SEQ ID NO: 2732 - DNA, 60 bp, Petromyzon marinus
  source 1..60: mol_type = unassigned DNA
tgacgatcattaagaaaaaataaaaactgttgcttttcacaatgccatacgaaagaagaa

SEQ ID NO: 2733 - DNA, 404 bp, Petromyzon marinus
  source 1..404: mol_type = unassigned DNA
taaactaattttcaatggtacagtatattttttcaagtagtggtatcccaaactttcacagcagcttatttcccttcacaccaacattatgtaaactcccccccccccccccccgcgccggtccatcatgtacctcctacgtacatcatgctcatttttatgctaattcctttgtcaaggcgtttttgtttcctcccacacagcttaaaggacgcgacctgggcttggctgtcttcactccaacgctgtcctctggacagtccggtcccttcacctgatgaaggccacttgtgttgtggccgaaacgtcgtgatttttgttgttttattttttacctacgtgactttaccgaatagaaccaaagagtatggatccttgcagtcacgaaagcttcaaatctagaa

SEQ ID NO: 2734 - DNA, 778 bp, Petromyzon marinus
  source 1..778: mol_type = unassigned DNA
tgacttgatttgtgttttcttgtcaacctccaccgtcagcagtgtgggtgtgtggagcgaggtgcaaatgattgcctggcggccctttgattggtgtagacccactgcgttggcgttgttttctcctacattaacattagctgccccgcccatgctgctgacacacttgggctacgcccatctctaaacctttataaacagtttgcctttagaggctaaccccccttttcctgatgacgaccgcttgtgttgcgatcgaaacgtcgtggtttttgtttttattatatttaattactgaaagaaccaagaataagtctacattatagactgccagtacgctcactcagtttaataaccattgctacagtctacatcatagactgccagtacactcaccagcttaaaaaccaggctacagtctacattatagactgccagtacactcaccaaggttaataaccaggctacagtctacattatagactgccagtacgctcaccgaggttaagaaccaggctacagtctacattatagactgccagtacactcacccagcttaataaccattgctacagtctacattatagactgccagtacactcaccaaacttaataaccaggctacagtctacattatagactgccagtacactcactccgattaagaaccaggctacagtctacattagtggtttttttgtttttatttttatttttattcactttattttttattattatttttctatctacgtgactttaccgaaagaaccaaaga

SEQ ID NO: 2735 - DNA, 916 bp, unidentified
  source 1..916: mol_type = unassigned DNA; note = Description of Unknown:Phanerochaete chrysosporium sequence
taatgcgattcgataactgctggccgcaatggtcagaggatatttacttagcggcatacactttggttcaaacccaaaacccctaacctaagccctaagcctaaatattcattagcgtctccctcacaggcctaaaccccctggagcggagttgtacccgttgaacggtacagccagcagttatagagtattttgttgtacagcgtcattatttaatggatgcagtgagcgcccgccttcgtggcgtgggcgcttcggtgatcgccgtgatggccgcgcacgtgtcccacgtgttcgtctcgtggctgctaatagcgtctgtgatcatgtgatcttcgacccagggctgcggttaactctggattcgatgcgcatgttaatagccggcccgaatccgggtcggctccgaactgactccgctaggttcgggagactttcgccggggtggctgcgtgccggacttcgtccgggcactttgtggcgttgatccgatcagatcgagatctcgagacttcgaaaggtgacttttcggtagtccgctgcccgctggggtgttgttggccccttccgcatgacctgtacattcaaaaccttcatactttcgccgagaaagagtcccttaaggggatttgttgctcccgacctcggggagacgtttctccgcgccaatcgcattacagccgatgagagacatttcgcctctcgtcggcccgccagtcccttcgggcctggcggttgcaaggggtatatatcccagtaggaaaccgctgatgagtcttcacgacgaaagctcagcgcgacacaacagtgtcggctgccttcggttttcctgtgaagcattccgcgctcgccgctcgctacgctcgcgtctcgcgccccccaaaccctaaaccctaaaccctaaaccctaataccc

SEQ ID NO: 2736 - protein, 30 aa, Spumavirus sp.
LIAAQNQHSAGILSSIYRGKYKTTLDLTNG

SEQ ID NO: 2737 - protein, 30 aa, Spumavirus sp.
LTAAQNQHSAGILATIVRQKYKTTLDLANG

SEQ ID NO: 2738 - protein, 24 aa, synthetic construct
  source 1..24: note = Description of Artificial Sequence: Synthetic peptide
  VARIANT 2: note = I, V, D, T, S, L, E, or K
  VARIANT 12: note = E, A, P, Q, G, H, or S
  VARIANT 17: note = D, N, P, E, S, K, A, Q, Y, or T
HXLGGLTSAGKXIKNKXEILALLK

SEQ ID NO: 2739 - DNA, 439 bp, Rhodnius prolixus
  source 1..439: mol_type = unassigned DNA
taggatgcagctaaactccatagttgcgattttagttcttaattactcacacaagtactatcataactacactactaattacaccactctaagctcacatcaaataacgaagtcacattcagagaccattgtgttgttctaggaaggaatgtcagtacgcagcgctcaagatatccttatctcatggaagccacgacgcagaatgtagtagaagagtggctggcatgacgaagaaagaagggaaagaggctgcgctattcctcaaattgaatattggaaaagatagggctggtttttttccaccaacatattggtaaattgaggcgctgggagccaactgtaattgttcatgccaatatgttggttttttccagccctcatataaagtaattggttaatgtgcaaacaagaccactataacaataaataaataaataaa

SEQ ID NO: 2740 - DNA, 48 bp, Rhodnius prolixus
  source 1..48: mol_type = unassigned DNA
tagtttatgtttactaaaatttacttatttattaaaatatataatata

SEQ ID NO: 2741 - DNA, 118 bp, Saccoglossus kowalevskii
  source 1..118: mol_type = unassigned DNA
tagtactgtaagtttttgttgttctgaatgttttgttttgttattgttatttttggactttactcaagatttcattggtacgttccaaataaaaaattctatctatctatctatctat

SEQ ID NO: 2742 - DNA, 165 bp, Saccoglossus kowalevskii
  source 1..165: mol_type = unassigned DNA
taatagttgttagtgttatctgttttaacattttattgtattttttatatctgtatttcttgttattgtgttgttgttgtttttgattattgaccatggttaatgtattcccaattcattaatttgagtcaaataaaatatactatactatactatactatacta

SEQ ID NO: 2743 - DNA, 61 bp, Saccoglossus kowalevskii
  source 1..61: mol_type = unassigned DNA
tgaatccggccaccctcgtcttcggggaccaaaccggatttaaaactctggactactacat

SEQ ID NO: 2744 - DNA, 157 bp, Saccoglossus kowalevskii
  source 1..157: mol_type = unassigned DNA
taattgtaatacgtattttatatataccctttgatttgtttgtaattttgaaacttttgttgtttttgtttatttgtgtttgttttttctgatctgtatccttaccatacagcacccactgatggtgcagttgtgtaataaagttattattattatt

SEQ ID NO: 2745 - DNA, 318 bp, Saccoglossus kowalevskii
  source 1..318: mol_type = unassigned DNA
tagcaactccatcaaattagtctgcaggtagttttaatgcaatggcatatttagtagcttagtagttttattgttatactaattttcatgtattttttcctccattcttagttacatgtattcaatgttttattcgtgattctggtggattgaactgtacttccgtcttgctttgtactaaacaataacattagcttatgtttaatgtgctatttgtgatattagttgtgtgaagtattatttctgttcttgttttacaaccataaaattactctctgtagtagattttcgtgttgaataaaattattattattatta

SEQ ID NO: 2746 - DNA, 207 bp, Saccoglossus kowalevskii
  source 1..207: mol_type = unassigned DNA
taattaatataacttattaagataccttttctgttttgttttttctaaccatttcttgttcttcgtttttatttgattttattatgttttcactwtgtcttcatttgtatttttcgtcttgccattctatatgtatttgaaactttattgtatttkaaaaatccagatcctgaacaggatatgatttcaataaaggcattacttact

SEQ ID NO: 2747 - DNA, 169 bp, Saccoglossus kowalevskii
  source 1..169: mol_type = unassigned DNA
tgaatttaatgaactacacgattgtattgttgatatattatttcaagctctctttcataacctttatttgtgaatgtaatcgttattatttaaggtgacttataagtccactgggctgggcagttctctgagctgcaggtcactataataaattacttacttacttact

SEQ ID NO: 2748 - DNA, 334 bp, Salmo salar
  source 1..334: mol_type = unassigned DNA
tgatgtattgttgtctctaccttcttgccctttgtgctgttgtctgtgcccaataatgtttgtaccatgttttgtgctgctaccatgttgttgttatgttgtgttgctaccatgctgtgttgtcatgtgttgctgccttgctatgtgttgtcttaggtctcttatgtgtgttgctctcttgttgtgatgtgtgttttgtcctatatttatattgtattcattttttaatcccagcccccgtcccgcaggaggccttttgccttttggtaggccgtcattgtaaataagactttgttcttaactgacttgcctagttaaataaaggttaaataaa

SEQ ID NO: 2749 - DNA, 427 bp, Salmo salar
  source 1..427: mol_type = unassigned DNA
taataacaagataaacaatgtaaaacatacggggtctgtaaaatgtatataggttcagaacttttgtgaaatagcacagttacaaatagaaatcaaactggatggacatcagaaatagaggaaggactaaaaacaaacaaaaaataactattgtaaaatagactgtgtctgtaaaatgtgtataagatgaataaactgaaggtaaaagccgaagtgtttattagtttactccaattgggggatcggtggtagggtttgcggggaataataataaaggtatattctttaaaaaagtatgtatgtctatataggtatgtgtatgtatatatgtgtatatgtatgcatgcgtgtatggatatatatatttaccccaaaaatatatgggggattggaaatgatgcagacaattacattgatggaagcaata

SEQ ID NO: 2750 - DNA, 186 bp, Salmo salar
  source 1..186: mol_type = unassigned DNA
tgagagatagaatgatggtcaaagataaaagtaaaaatttaaaaaagtaaaaaaaacataataaaaagtacatttgaatgacactaagtggcagtgtttttacaactaatgccggtttgcctgaggctgatgccgtgccggtgtttgtacacgtgcatatacacacactctcattcaaataaacac

SEQ ID NO: 2751 - DNA, 338 bp, Salmo salar
  source 1..338: mol_type = unassigned DNA
tgaatttgcactttttaacgcactctcaattgtmatatggtaatctacctttgggcagcatgtgctggccccgccacccgagcagttgggaggggaatagggtggaataagggggggataaaggggggtataagtgggggggttacatcgacccttttttctttctacctgtccttgttctgtatgtcttgttttgtaatatttgttttgtgcccagaactctgggtcttttggttaatgtctgttctcttatgtttagataagaactgtaaacttgtcttttatacctatacaccattcttgtgtatgtgttcaataaaaaatatttgaacaaaaaa

SEQ ID NO: 2752 - DNA, 349 bp, Salmo salar
  source 1..349: mol_type = unassigned DNA
tagctgtgtattgccgctttccatgttgtctgttgtctgtagcttgtgaggtgtggaaacactttgttgtttttatggattttgtcttgttgctttttgttctatgttgctctgtctgtatgctacatcttgcttgtcctatgttgctctgtctgtatgctatgtcttgcttgtcctatgttactctgcgtgtgctcactgttcaatgattgtctatattgtaattgtttttaataacctgcccagggactgcggttgaaaattagccggctggctaaaaccggcacttttactgaaacgttgattaatgtgcactgtccctgtaaaaataaaataaactcaaactcaa

SEQ ID NO: 2753 - DNA, 374 bp, Salmo salar
  source 1..374: mol_type = unassigned DNA
tagccggctaccacccggttactcaaccctgcaccttagaggctgctgccctatatacatagactggaatcactggccactttaataatggaacactagtcactttaataatgtttacatactgctttactcatctcatatgtatatactgtattctattctactgtattttagtcaatgccactccgacattgctcgtcctaatatttatatatttcttaattccattcttttacttttagatttgtgtgtattgttgtgaattgttagatactactgcactgttggagctaggaacacaagcatttcgctacacccgcaataacatctgctaaatatgtgtatgtgaccaataaaatttgatttgatttgag

SEQ ID NO: 2754 - DNA, 250 bp, Salmo salar
  source 1..250: mol_type = unassigned DNA
tagtcactttaaccatacctacatgtacatactacctcaatcagcctgactaaccggtgtctgtatatagcctcgctactcttattttcaatgtctttttactgttgttttatttctttacttacctattattacacacatacttacctttttttccgcactattggttagagcctgtaagtaagcatttcactgtaaggtctacacctgttgtattcggcgcacgtgacaaataaactttgatttgatt

SEQ ID NO: 2755 - DNA, 209 bp, Salmo salar
  source 1..209: mol_type = unassigned DNA
tgacctagatagtttgtgtgtatgcattgatatgtaggctacgtgtgcctttttaaaaatgtatgtagttcgtcgagctgttcttgtctawtgatgttctgtattatgtcattctgtattatgtttcatgttttgtgtggaccccaggaagagtagctgctgcttttgcaacagctaatggggatcctaataaaataccaaataccaaa

SEQ ID NO: 2756 - DNA, 356 bp, Salmo salar
  source 1..356: mol_type = unassigned DNA
tagtcaaatggctacccagactatttgcattgcccccctcctccacaccactgccactctctgttgtcatctatgcatagtcactttaattaactctacctacatgtacatactacctcaactaaccggtgcccccgcacattgactctgtaccggcacccccctgtatatagtctcgctattgttattttactgctgctctttaattacttgttacttttatctcttattcttatccgtatttttttaaactgcactgttggttaggggctcgtaagtaagcatttcactgtaaggtctacacctgttgtattcggcgcatgtgactaatacaatttgatttttgatttgatttg

SEQ ID NO: 2757 - DNA, 149 bp, Salmo salar
  source 1..149: mol_type = unassigned DNA
taggctggatcatgttgttgtattgtattgttgtatgttttaattatgtaatgtattgattgttgctgccttcttggccaggtctcccttgaaaaagagactctgggtctcaatgggcttttcctggttaaataaaggttaaataaaaa

SEQ ID NO: 2758 - protein, 31 aa, Gammaretrovirus sp.
HIHGEIYRRRGLLTSEGKEIKNKDEILALLK

SEQ ID NO: 2759 - protein, 31 aa, Gammaretrovirus sp.
HVHGEIYRRRGLLTSEGREIKNKNEILALLK

SEQ ID NO: 2760 - DNA, 683 bp, Schmidtea mediterranea
  source 1..683: mol_type = unassigned DNA
  misc_difference 366: note = a, c, t, g, unknown or other
  misc_difference 525: note = a, c, t, g, unknown or other
taactctgatacttttacttaaagattaaaacaattttatagcaaaaaaggaaaaccttcaggaatgaaaatcagagtagaattgtatttaggtcttgaagttgtttgtggagggttgtttgaaggcttttttgttgcgtttttaagaggaaagctttttcatatacatctttcataagactttaaaaactcaggaactatttattaatttgctctgaattttataaaaaactttctttagttttaattttattaagaaatttgaaagacaaaaaaaaatgacgttagaagcagttatttaacataagatatagaaaacattttaaaattttaaagttttatataaaaaaattaaagtttataaanattaaattaataaatgttaaattaaacaaaaaagagaggaaaaaaatttattttaaaaattttaaattgtatattttataaaagatatttaaatttttaaaattttaggtttaaaatgttttaaaattaaatttaaaccaatcaaaaagcaaaaaagtnaattttaatgaaaatcagaaggtatttcggcatttttctcattgtatatagtagttccgaaagaaactgaagaggattatttaataatcgaaacttttttcaaaaatataattattacttcgcagcaagggcttattttgttaaataataataataat

SEQ ID NO: 2761 - DNA, 78 bp, Setaria italica
  source 1..78: mol_type = unassigned DNA
tgatttgtggctcttgttgggtttcaactctagcctaccccaacttgcttgggactgaaaggctatgttgttgttgtt

SEQ ID NO: 2762 - DNA, 277 bp, Solenopsis invicta
  source 1..277: mol_type = unassigned DNA
taggccctcaagccctgccgggggcgcccatcgctagggcgcccctggcgagccgagtcggccgccaaggccgaccgggtccggggggctccggaagtatgctgcacgcgttcccggagccccccagtcatggaccagggcaggacacccggagaggttttagtgggtaggccctcgccggcacgtcgccggcgggggagagccccacataaccaccaggcctcccccggggcctggggtatgcggtaacgcatttcctctccgtgaacaaaaaaaa

SEQ ID NO: 2763 - DNA, 306 bp, Strongylocentrotus purpuratus
  source 1..306: mol_type = unassigned DNA
tgaagtggccggagtggcaatgcctaaatcgaatgcggacgagaatggggcggtgtaaggtcaatatggcaagatggggctatgcccatgaaggagatactctctgcgactgcggagagactcagacgatggaccacctcttgcagtgcggcggaacgggttgcacagatgaagacctgtcccttgttaatgaaacggccattgcagcaatcgagcgatggaagaacttaatttaatttaatttacttctaagttaaggaactttacattactatcttgatctaaggagacacgaacgaacgaacg

SEQ ID NO: 2764 - DNA, 660 bp, Strongylocentrotus purpuratus
  source 1..660: mol_type = unassigned DNA
tgattgtatttaatatactctgaaacaaattaaattgtcaaattacaatttcatattccttagtatataattaattcataaatttgaggtctgattttttaccaagttagtcaatgtattttttatgacatgaagaatgcgatgcatatctatatttatattttaatatctctaatgttcgccttataatattcatatttgtcttgcaatgtatctttgtattttatcagcatgtacataattgttttccctctctgtccatctgtcccctttctcccccctctctctctctctctctctctctctcttctctctctctctcttttctctctttctttctctctctcctgctttcccatctctctttcttttttaactcaaatttttaaattgaaatattgtataagattaatggtatatagtatatacacgctcttcataattatgtagattgtagtgtgacatcttgaaatgtatacttgcttttttccagcaatttactcatgtgcaattcagttactttttactgtgatatctcttgaaatgtataattgtcttcaccatcaatgttttattcatgcgcaattcagttacttgtaactgcgatacatggaaatgaatcaataaataccatttatctatctatctatctatctatca

SEQ ID NO: 2765 - DNA, 48 bp, Strongylocentrotus purpuratus
  source 1..48: mol_type = unassigned DNA
aaatgaaggcggtcattgtcgcttcgcgacagacagctactactacta

SEQ ID NO: 2766 - DNA, 395 bp, Strongylocentrotus purpuratus
  source 1..395: mol_type = unassigned DNA
tagtataacaaaaccgtgacttatttattctttatcatgcaactgcttactgcacctgcacttgcaccgcaccctcttgatcactcagtttttcgaagagagttatgtcgccaattctttttacgaggccgccatccatctccagcctaaccgctcacgatggtggtctcctgcgttctaaattacctctctaatttattgaaaatatttcatattatgttattgtatgcttcgtacatgtttatcgtatgatataattgtacatgattttttatttaattacttttgtaaacattttattcattgtatttgttattgttcgaatttttgtactttgaatttgaatttgtatatttttgaacgcagaaataaaatcaatcaaacaaacaaacaaa

SEQ ID NO: 2767 - DNA, 170 bp, Strongylocentrotus purpuratus
  source 1..170: mol_type = unassigned DNA
taaattccggcaacgttttttttttactggcactatgtatatatacacctctcacctgcacacctggacatccccatgtcgccacacacatgcactcgcacacatctgcaagaatcttcagcagtgaaggaggcagattattttgaagaagaagaagaagaagaaatata

SEQ ID NO: 2768 - DNA, 42 bp, Strongylocentrotus purpuratus
  source 1..42: mol_type = unassigned DNA
tagatgatgtactccctgatattctttgcacgaacgaacgaa

SEQ ID NO: 2769 - DNA, 141 bp, Strongylocentrotus purpuratus
  source 1..141: mol_type = unassigned DNA
tagaatacccgacgcagaactgagccagacacttaccaagaagacacccaactacgagaaggaagaaaatgaaattgaactggaagcccgactgctgagaacacagcattcttccagaatctcgggtaaaggtaaaggtaa

SEQ ID NO: 2770 - DNA, 585 bp, Strongylocentrotus purpuratus
  source 1..585: mol_type = unassigned DNA
tacagtctttctttaggtcaagtatagttttgatggtttgtttgttcttttgttcattttttttttttttgttagtatactttttgttttgtttgtcttattacattatattccattatgtttttgtttgtccaatggacgattatggcgtattttgttagtctgcatatatcttaacaatccaatcacaactcacttacatgtacaaaaatgaaacttataatttcttttttagttaagacaataatgtatttaaaaaaaaaaaattgtaaaattattttttgtttttatctttctttttcttcgtgtttgtatttagattgttcatgtggtattttccacttttcatgtatgcttgccatattgtataatattgtatttatgtttagcataggctaggtttagatcattcctatttatcgttatacttttatattgttgttttgttgtattctgtattctttgtattattaagctatgtttgtattctttattatgtatcattatcatgacatgtacatgtgttgtactctcataccccagaagggggtcgaatgagtcaataaattctattctattctattc

SEQ ID NO: 2771 - DNA, 1033 bp, Strongylocentrotus purpuratus
  source 1..1033: mol_type = unassigned DNA
tgaactttgtataaactctaatagaaggggcaaacagactttagtatgactgattttaaatgatatttgcatgtttttaattactcactttgaaattaaaataatgttttttaaaacatatagtttgggattattactattgcctatttccaatgcatgaaaccttcgggcgtagacgcggaggagtggtctattgttagtgaggaggatgtctgttgttgttttctttgttcatcccctcacttcaatagataacctaccgtgcctgcgcctgccaacatggttatgttttaggatcttgtttattacatcccagcctttttaaatagatttaattcaccttagctaaactggatcatgtttttttttactctttactaattaactggataaatcactcgagcattataatacatgtaccatatttaaagcatgacctatagtatttattcattcacaaaaaatgtgatttcatagaaaattgaacgattaatgctaaacatagatttatatttttgtaattttccacacgcaacactactattttcagagttgaaatgttctaaaccagttaattgccatgtacagtattacgcatgtatttcttgttaagtatgtaatgttttaatcatgtaaaagttatcattttcttatactccctccccctttctttctctcctccgccatacctgtccttttgtattcattatttcactgtgaattgtgctgtatattgtatgcatgggtgttgatccgttgcgtcgtgctattcatcaggggggtatatgatcttactgtttcgtgccccactggtgactggggtggcgcagcggttcgacgccggtgccaagagttgcattattatctatagtagtttattattagtaagtgcaattttaccttgtaataattaattctgtaatccattgcgcaatttagtttttagctacgaagcatggaattaatgaacatttattgtttacatgtttgatttgatttgaataaaccatttatctatctatctatctatcta

SEQ ID NO: 2772 - DNA, 121 bp, Tetraodon nigroviridis
  source 1..121: mol_type = unassigned DNA
tgatgaagccttttggatagaaggcgaaacgttttccaaaaagaaaattgaaaagtccagatgaacacagaatcttttctcggataactatgacctggatgactgagaacctacacagaca

SEQ ID NO: 2773 - protein, 31 aa, Gammaretrovirus sp.
HVHGMIYRERGLLTAGGKAIKNAPEILALLT

SEQ ID NO: 2774 - DNA, 120 bp, Tribolium castaneum
  source 1..120: mol_type = unassigned DNA
cttatgtcttaaaattatttttatgttattgttatttctgtgtataatactgacgtttttcgtatcaattttgttactacatctgtataaattgatagaaataaattattattattatta

SEQ ID NO: 2775 - protein, 31 aa, Gammaretrovirus sp.
HVHGAIYKQRGLLTSAGREIKNKEEILSLLE

SEQ ID NO: 2776 - DNA, 275 bp, unidentified
  source 1..275: mol_type = unassigned DNA; note = Description of Unknown:Trypanosoma brucei sequence
taataaacgaataacaaaaatcaaaacaaaaggattgctaattgacatcttttggagagtccggggtggggggcttctcgccccatctgctgtattccgttcaactgcggagctacaacaaaaattatagagggtgtgttaggctgaataaaaaagggagactctgccacagtcgccagaccgatagcatctcagggctctacggtgatggctgatggccgcgccagtggggggaaactctcacgaaggcacgaagaaaattccaaaaaaaaaaa

SEQ ID NO: 2777 - DNA, 399 bp, Xenopus laevis
  source 1..399: mol_type = unassigned DNA
tgaccttactatataccacaacgttacacacccttgtataaataaatagccattggatacaattgttctctatgagcacatctgcactttatcatgttctttatcatgttcttactactatcatatcacaatgatacacccatcatgtctgacgtttagcattatttacttaacatattacatctgctgagtgtgcactgtcttgtcctgtccctgcactgtgctgtcctgtcttgcaggagttgcatatttttgcacttgcactttttgtctgttgtccggtacatctatgttgtgtgtagcaccatggtcctagaggaacgttgtttcgtttcactgtgtactgtacaaacgtatatggatgaaatgacaataaactcactcttgactcttgacttg

SEQ ID NO: 2778 - DNA, 330 bp, Xenopus laevis
  source 1..330: mol_type = unassigned DNA
tgaactggcacttatataacagtgtaacaaactgtaacccacagcaccttaatacccctctgaattgtgtctgtatgttaccctcccatttagactgtaagccctacggggtagggtcctctagccttttgtttccttgacactgagcacttaatctgtattgtaattatattttatatttatgtgaattgtatttctaataatgcacttattgttactttttattccaatgaccccttgtttgttactactaatttattgttttgctgtacagtgctttgccctcaaggagcgctatacaaataaaaatatacatacatacatacatac

SEQ ID NO: 2779 - DNA, 309 bp, Xenopus tropicalis
  source 1..309: mol_type = unassigned DNA
taacaccttcatcaatgagaatcttggtaccattgtgattggatcataccttcttacacctgtcagtttcagctaacacctaactgaacaagttcaatggaaccattgtgattggatgtctgtgactctactaccatcaagagtttaaataccggggaattccctaccagtcatttgaactgaagaagccactcggatgagtggtgaaacgttttcaagaaaaactcagaaaagtccagttgttttagacttaattctactagatactgtatatcatgacctggatgaatgagaatcttcatagacata

SEQ ID NO: 2780 - DNA, 263 bp, Xenopus tropicalis
  source 1..263: mol_type = unassigned DNA
taacacctgctttgaagagttgcatgatacttgggtaatcctttcaaagtaactccacagcattcacacctctgtgagtttcagatgtcacctttctgaagagttacatagtgccattgtgattggattagtggaagagtatatatgctgaggacttcccataccagtcagttgaactgaagaagctgctcggatgagtagtgaaacgtcttcaatgattactaaacaagtccagttgctttaaatttatttatactagatat

SEQ ID NO: 2781 - DNA, 317 bp, Xenopus tropicalis
  source 1..317: mol_type = unassigned DNA
taaaacattattttgcctagtcctgcgcttaagggcaaatgcccatacctggtgcactcttaccttccaatttgtgcctgtatgttacccaaccacttagattgtaagctctacggggcagggacctccttcctactgtgtctcataccacatggcacttattccctgtgcatttatatatatttattgtatttatttattataacacttgtcctccctgtgtgtaattttgtattttgtaagattgtacagcgctgcgtacccttgtggcgctttataaataaagttatacatacatacatacatacatacataca

SEQ ID NO: 2782 - DNA, 148 bp, Zea mays
  source 1..148: mol_type = unassigned DNA
tagagtttttatagatgagtcagtctatgctagtttcgttcaggccgccgtaaggcgtcagttgtaccccggtctattttagaccttgtttatttcttcttttaatataatgatacgcagctctcctgcgtgttcgagaaaaaaaaaa

SEQ ID NO: 2783 - DNA, 153 bp, Zea mays
  source 1..153: mol_type = unassigned DNA
tgattaggccttttcccttttagtgctctcaaaagcttttcccctcccctttctctctctttctctttttggtgacatcttgttgggtttcaactctagcctaccccaacttgcttgggactaaaaggctatgttgatgttgatgttgatgtt

SEQ ID NO: 2784 - DNA, 166 bp, Zea mays
  source 1..166: mol_type = unassigned DNA
  misc_difference 41: note = a, c, t, g, unknown or other
tagctagcattgtggtaattcgtgttagtttcttctttagncatggatgggtttctgtatgcctgttactggccgccgtaggcgcctcttttgttttcttctgtaactgtccttcttctttaatataatatcgcgcagttctcctgcgctttcgagaaaaaaaaaa

SEQ ID NO: 2785 - DNA, 3999 bp, Zea mays
  source 1..3999: mol_type = unassigned DNA
tgatgataggcctcatttggaattgtcagggtttagggaatagttctaaggttcagtttctgaaagaactcattagagatgagaaagttgactttattggtttgcaagaaacccaaaaaagtcattttagtgattcttggttgacttcgctggctggtagtaaaccttttgcctggttttctgccccgcctaatggtagatctggtggtttattggtgggttttaatactgatgtgtttgatgtgagagaaaatgaaattggtgaatttatgattcgcaccttgatttttcatagagaaaaaaatctcatctggaactttgttaatgtgtatggtgctgctcagaaggagaacaaatgcagattcttgagtgagctttcgtctttttgctcgagaagtcgtgctcctttgcttgttggtggtgattttaatattattagaaaagcagargagaaaaacaagcctggtggtgttaataagtggagcttcctttttaacagtatcattgagcaaaatgggcttgtggagtttgacttgaacaatagattgttcacttggtctaataatcggattgaccctacttttgaaaagttggatagatttctggctagtcctgagtgggatcttgcttataataatatcaatgttcgtggtttgaatagatccttttctgatcatgttcctttatgcattcaaacggatgttatccctactggcagtagagttttcaaatatgagttatgttggaaggttagaccagattttcacaaaaaagtgatagacaattggtctattcctgtgaaggctaaaggtagtattgacatttggaaaacgaaaattaaacgtttgaaacaaatgctcaaaggttggaatattaatgttgaagggcattacaaaaaatgaaaaaagaattgttggcaaaaattgacatctttgacaaaatcagtgaagtggttggtctttcagaaaatgacaggatggagaaacttgacctggaattgactctcaaaaaattagttgatgaggagggaattaagctcaaacagagagctcgtgataaattcattttggatggcgatgagaattctaaatattttcatcttttagccaagtgtaagagaaggaagcttaaaattgtgactcttactcatgaagacaaagttgctcaagatgatgatgaaattaatcatttggcgacttctttttaccaaaatctgtttggtccttctcaagaatctagtatttctttgaatcatttgaatatgaaaatgttggatgatactgacagagattgcctgaccagaccgtttgacatggaggaaattagagaagtggtgttttctatgaaacataatagagctcctggtcctgatagcatcccagctgaattttttcaggagttttgggacacgattaaaaatgatctgtttaacctctttcaagattttcatgatggcactcttaacattgagagacttaattttggaatggtgactcttattcccaaagttcctaatgctattgacattaaagctttcagacctatttgcttgcttaatgtgtgttacaagattattaccaaagttttgaccaacagattggccagttgtatcaataatgtgattagtgattttcagtatggttttatcaaaggtaaatacatcatggatggagtggtctctctccatgagattattcatgaggtgaaaaagaagaagcagagtggggtgatttttaaggtggattttgagaaagcttatgacaaggttaattggaactttcttcatcatatgatgattaaaaaaggttttggtgacaaatggtgtgactgggttatgagaactgttagaggtggtaaagtggccatcaagacaaatgacagggttggtccctattttaccactcacaaaggtgtcagacaaggtgatcctttctccccctgctttttaatattgctgctgatgggcttgcttgtatgattcaaaaagccaaagatgaaggtattattaggggactcattcctcatatcatccctaatggttgttgttgtttgcaatatgctgatgataccatttttttgcttcaagatgatctggagggagccagaaatcttaagtttattctttgcttatttgaacagatgtctggtctcaaaatcaattttcataaaagtgaaattttctgtttaggtgaagctgttgataaggaaatgtggtatgctgacatttttacctgcccttataattgtcttcctatgaaatatttgggggttccgattgatgacaaaaaactttgcaagtccttgtggttacccacagtagagaaagttgaaaaatgggttcttggcaaggaaaattccttagtttgggtggtcggttagtcttgattaatagcagtcttaccaatgtccctttatacatgctctcgatgtataaagctcccaagaatattttgaagaaaatggatctctttagaaaaaggcttttgtggcaaggtggccatactacaaaaaaatatcatttggctgattggaatatggtttgttctccgagaggtcagggtggccttggggtcttggatctgcacaagatgaatgaggcgcttcttgctaaatggatttggaagttggaaaatacgaatgggctwtggcagaccattatcagacataaatatgttaaaggaaggcctattatttcattaaaaaaagacaaagtgattctcacttttggaaaggtattctggatgctcgggacaatttttacaaatattgtaaaaaaaggtaggcaatggcaataataccagcttttggcacaatatttggtgtgatttagaacctctgtcttctaaatatcctagtttgtttgatattgcttatgataaagatatcacagtggaaaaagccttttcttctgattttagagctgtgaattttagaagaaggatttatggtgctttggaagatgattataataaccttattacacagtgtaataatattactatttctgaggaggatgataaatcagtttggcttctgggtaataaaggtttttctgttaattctttttacaaagaaatcaaatgtgctcagattcctttgccttctagtttcttgtggaagactagactcccacataaaatcaaagcttttttgtggcttgttatgcataaaaagattttaaccaaggataatttgttcaaaaaaaattggaagggcaatctggattgtactttttgtggattttcagaatccatagatcatttgtttttcagtgctcggttgctagatttacttggagaatagtctactcggctcttggcttaatttctattcccaacagtgtggatgatctgtttggctcttggattaatagttttaacaaaactgaaaagaatctggtcctttttggttgtggagctgtcatttgggcgatctggcgatgtcgcaatgattgttgctttggaactgacagaattgatgatccgactaatgtgattttctcttgttgctattggcttgatacttgggctatccgtcagaaaaagaaggaaagaaaattggtggaacaaggaagcctcaaaatcagaaggatggcgtgtgagatctacaacaagactcgtggttggaagccagtcgacagacggatccaatgaagattctgctgtgtttggctattttggttcatcaactttgtgtttgctgtaatcccccctcgcctcggtagcttcaggctactgaaaactttgggctatatcggggytgaagttgtttagtttcgtgctactctagtttgatctttgcgatctttgtttttggtcagctatgtgctgattctgtgctgcttctggtagtttggttcgttcaggtttagttccgtcgtagctgatagttgtgtgtcttgtcggcttttaaattctggttggctctatggtcttgtaagaacttgtgtctctttctatttcgtaatgaaatagggggttatcccctctgtcaaaaaaa

SEQ ID NO: 2786 - protein, 908 aa, synthetic construct
  source 1..908: note = Description of Artificial Sequence: Synthetic polypeptide
MPNLKTLTKELRQEIVSYLYPLPSISSNLAFRLAIHIFTKTRFSSHINFISRCLQHKVIPKGFRSNFHASIFSNVSNFNLKYLHEIQRTQNTFSHNIMRSTIRAMCSKRNELNKQIIECRSQLSNVCPSVLLRSIHAKIQALNSKLFHHLEQTKKHKLENLTNSPKNRTEPLENQNHHTVVTIPENLPLSNAEKSVLSKGLNFVPISKKSDEFTTRQDVEKFLRRVQLKAFFHNKEDKSDNTEKDAFETLTAKKSKWTPPEGQFASIDYFIKKCRHDVHKLKSNCNTKLSNLSKEEWTALINLKNRKDLVIKAADKGGATVVWRTDLYQQEAIRQLSDPTFYTKVNKDLTPANQKIVKDTIQELIRKQELPVTAQNLIITTPRTSCIYFKPKIHKPNNPGRPIVSACSCPTELISSYLDKVMTPIVKSLPSYIKDSNHALETFGNFNFSGENKIIFTMDITSLYTVIPNNEGLQALKYFFNQRPIKKPSSETLLRLAELVLTLNCFSFGDNYYKQINGVAMGTKMGPSYANLFVGFIENKFFSNYHGPKPDLYKRYIDDCVGATSSTKEELNLFINSVNSFHPALKYTWEISENSLAFLDIKLSINGNGLSTSVHYKPTDSHNYLLHSSSHPQHVKNAIPFSQFLRLRRLCSDDTDFNNKCEEMCQFFKKRGYPDSAVTTGKHRAQEIDRETALQTSQNEETDRIPFTLTYHPQNLAIKNVILKNFKILSNDPETKHIFSLPPLISFKRDKNLGNFLVRSAFKFNNKPGTFTCKRTRCKTCPFISNTVNISGPNRSVKVTDHFTCISSNVIYCITCTLCKKIYIGETGRRLADRFREHLRDAEQNNTDASKPVARHFNLPNHSHHNMTICGLYLHHGNTESRKNLEQKLIFQLGTLSPHGINERLSFH

SEQ ID NO: 2787 - protein, 690 aa, synthetic construct
  source 1..690: note = Description of Artificial Sequence: Synthetic polypeptide
MRLAEYFFDENSNNRTANEHDTPFHNKSTWNPPNDRERALNTFLDAVKLDITTTKPKPTQDNLTVTERQAIGQLKQRQDIIIKPADKGSGTVVMDKTWYIDECNRQLTDTKFYQRLDEDITADIQKRVTFYVNRMHKDKLINDKTKQYLIQSDVKPGRFYILPKVHKPGNPGRPIVSSNSHPTERLSHFVDYHLQPLVHKLPSFVKDTNDFLNKLLTIGNLPANSLLVTLDVSSLYTNIPHNEGINACERFLRTSSHKTIPTSTLCDLIRMILTMNNFSFNDNHYLQIHGTAMGTKMAPSYANLFLGFFEANALKNAPFQPHTWLRYIDDIFMIWTEGLDNLKIFIDYLNNIHSTIKFTSSHSSTNIPFLDVNVSLTNDGNISTDLYTKPTDKHQHLLYSSCHPLHTKKAIPFSLALRLRRICSTDATFHTRTAQLATYLLKRGYNRNFVNKQIRRAADIPRQLTLQTKDINKPKRIPFITTFNPSLPHISHIIKKHFNLLLSSNRCKSVFQHPPVVAFRRSPNLRDLLVTAKLSPNSTNPQLPCGSFRCGKNCATCPYISHGLTTYTFFSTGETRPIKFNFTCETKNLIYMIQCNRCNLQYIGETKRRLKDRFNEHRRTIDNPNNKSKPTTAAEHFLSSPNHTANDMILIPIEKIFSNRDSIRKAREAFLIQKGRTIDPDGLNIREETY

SEQ ID NO: 2788 - protein, 795 aa, synthetic construct
  source 1..795: note = Description of Artificial Sequence: Synthetic polypeptide
MTPGFKPFTILRSLGRQSERLANNYISYASNVRRIRQQLWFNHRCKDLRLVPSGLRLKSPLNTQEAIQIVKATCRRLIRARINDCHRRLNHYNNRLQQRLDKLKQLIPTNLLDVIRDIADQRAKKTTEQYRIKTELKLTRLQRTKNKKRHKTDENWVRNISSRPLDKTETQVLSYGLKHSVTPKRIPTETIVSSVEAVLSRQRDLSEPTKDNIRSRIASTIQSASLTDNNLTKDERQALKRLRNDNDILILPADKGRVTVVMDKTDYHDKMDELVNDKQTYEVLKRDPTPALQRKLNSKLLQLKKADAIDIRRYNRLRCPVPQPAKLYGLPKLHKPNVPMRPIVSFCGSPTYELSKYLTTILKPLTDESRHKLQSTETFIDAIKTAQVPDDHKLVSFDVKSLFTSIPLQLALDCTETAINNSTLQLPLLTNDLMDLLNLCLTSTYFQYNGQHYKQLHGTAMGSPVSVVVAEIVMQNIEEQALASYKRTIPLWLRYVDDTFTTLHKDEIDDFHEHLNRQNAHIQFTKEIEDNGKIPFLDCLVIRDNNRLQTTVYRKPTHTDRLLDESSYNPSSHKATTIRTLTRRALLVCNSHDSLADERKYLDNVFSKNNYNCDFVTRNTYRTEPNETNTNLTPTTTVTIPYIKGTSEIIARILQPYNIRVAHRPITTLRKLLTNVKDKDQPRDRQGAVYKIKCCDCQATYIGETGRNLNTRLTEHRRATRNGDINNNIAEHHLQTNHRIDWDSATCVTYNTNYYQRIVLESWFTNLEQTPINRCLQLPAPYKRLIDDINRQTTH

SEQ ID NO: 2789 - protein, 1286 aa, synthetic construct
  source 1..1286: note = Description of Artificial Sequence: Synthetic polypeptide
  VARIANT 490: note = Any amino acid
MPGPALGGAPLESATRTLCPPNGFSQTYFSTAAPSPLPVVGSTPGPTLGGALSGSVSSTFLGSTNSKETSLSSFPVPALPTSHNFILQWNLNGYRSRLCDLELIIQNNQPWILALQETNNISADEMGRTLGGQYAWTVKRLANQRHSAAIGILKGIPHKILDLPSDLPIVGIQLLGSPSVSVACAYLPGGNIPNLHGQIQNCLQALPEPRIFLGDLNSHHPVWGSPKADKRGSTLINAFEEEDMLILNDGSPTFFNGHFSSEIDVTAVSLSFARNIQWSVSSDLHGSDHFPIRIALTTGASIPKNTRRPRWKYDKADWAEYDLLIRSALRNSPPDNMADFISTIVESAKATIPRTSSTPGRKALRWWSDETKTAVKARRKALRQLRRLPLDHPDRQSTLENYRKLHLECRNIIGDAKKATWESFLESMNASQTTSELWNRVNALNGKRKTTPLTLQVQGNAISDPEAVASELGKYFASLSAIESYETHFXNSVKPSTSAINNFIIPPNTADPEMEQPFSARELSFALSRSNGRSAGPDEVGYPLLKNLPSVGKLALLDLYNKIWANNDFPPAWKESLVVPIPKANIPTRDPTKFRPISLTCCAGKVMERMVNRRLRYHLEANGLLDFRQHAFRQGYGTSTYFAGLSDVLKEAYDKGNHAEVISLDISKAFNRTWTPLVLEQLAAWGIGGRTLHFVRNFLADRTFQVVIGNTKSSTFPEETGVPQGSVLAVTLFLIAMNGVFSRLPKNIYVFVYADDIVIVVCGSTPTMTRIRAQTAVKSVAKWASDNGFQLSASKSIRCHICPSGHRITGPDITIDGQPIPLRKTVRILGVIVDRALSFRQHFDTVKSACRSRLNLIKSISRPHRSNNREIRFRVARAIVDSRLVYGLELTSIAMDRLVEVLSPIYNSYIRIISGLLPSTPSDSACVEAGLLPFRIFIRSSICCKTAAFLSKTAGEDRVFLLDEGNRALSTAANLSLPPVTRVHWLGDRSWRSVPPKIDNKIKNSFSAGSNSAALRRSVAELLQTSYSDFALRYSDGSLTSAGVGIGVAGDIPDVSMSLPSQCSVFSAEAAAAFIAATTPSDRSILVLTDSASVISALQSDSPTHPWIQAILKYALPDTVFTWIPGHCGVPGNEMADHLARSGLSGQRYTSEVPFMDLKRWIKSTFRQHWEDSWYRTRTLFLRKIKNSTTTWSDLPILKDQRILSRLRTGHTLISHNMGGGPFHKECESCHIPASVDHVLCACPMYEHLRQIHGLSDNIGEVLRDDATTIAALLSFLRDANLYSSI

SEQ ID NO: 2790 - protein, 955 aa, synthetic construct
  source 1..955: note = Description of Artificial Sequence: Synthetic polypeptide
  VARIANT 261: note = Any amino acid
MKLEILGLSEVRWPNFGEHRIPSGQILLYSGLRGEHAPRHRGVGFLLSAQAYAALMKWEPINERIIVARFRTRVRNLTIVQCYAPTDAAELQDKENFYSQLNAVVDKIPKGDIKIYMGDFNAKIGSDNSSYEPVMGRHGLGEMSENGELLAEFCGNNDMVIGGSLFPHRPVHKVTWVSRDGFTENQIDHICISRKWKRSLLDVRNKRSADIASDHHLLIGEVRLRIARIRRQEERVGRRFNTRRLEDATVKRSFVEELETXAANISEGGSVEEQWTAIKNAFITTSENNLGELRTRRKQWITDETWRKIEERREAKAAIERAKTRGAKALSRQRYSALEREVKRSCRRDKRAWADSLADEGEKAAATGDIRLLYDISRRLSGAKMNTTMPVKDTTGQLLTDPTDQLKRWFEHFEQLFQVSTRPPTPQHDPPRVRRISRVNTEAPSLHEIETAIQSMKSNKAPGVDRISAEMLKADPAISAQLLHQLFRNIWDTATFPADWMQGVLVKVPKKGDLTVCDNWRGIMLLCIVLKVLCKVILNRIQEKIDATLRRQQAGFRAGRSCVDHIVTLRIILEQVNEFQESLYMVFIDYEKAFDRLNHENMWGALRRKGVPEKIIGLIEAQYEAFTCRVLHNGVLSEPIRVVAGVRQGCILSPLLFLIVIDEILIGAIDREQNRGLLWQPITMEHLNDLDLADDIAILAQRRSDMQSKLDDLAERSSAAGLNINVNKTKSLDVNTAGPSSFTVAGQTVENVENFQYLGSQLASDGGTKIDIGARIKKARAAFASLRNIWKNSQISQRTKIRIFNSNVKSVLLYASETWCVSAENTQRLQVFINRCLRYIIRAWWPHNWISNADLHRRCHQQPIQTEIRQRKWGWVGHTLRRGGNEICKQALEWNPAGHRSRGRPRGSWRRSLNKEIKEVDGNLTWPQVKAIAGNRPGWKSFTSALCTRMGAQDP

SEQ ID NO: 2791 - protein, 797 aa, synthetic construct
  source 1..797: note = Description of Artificial Sequence: Synthetic polypeptide
MASTLSESNTFIKLKKSIAGLKKDIAFLSECRKLNLTPKSHKIKVRGQVPQDIIKKMESEYLRSSIKKLHSKLNSQTLKCYSLHLKLAKQYPWEFPLFLTKVIQAEECEARRKKDIHSKKLAILKNKQHNKVVTALPKVHSIEGFVVNRSTQQFSEEQLTLLNKGLAYAVATKPDIEQTIIDVETAITHTIPIEFQESARNDTEESLKGNKFQLRGQNSDEDKVLSELRDKSVYYVKADKGNAVVILDKDDYDNQMNEKITTGPYRHFRVDPLPTMVRHVEKTLKECKPLLGDNTSRLKVSNPVLPRIKGLPKIHKPGNEMREIISAEGSPTHKLAKWLVKEFQSMPKPFESRSVNNTQEFASQLQASGYIQDDEIMVSFDVKALFPSVPVKEAINLLEEWLLNQHNESNWKNKVRYYIKLTRLCMEENYFSFRGNFYKQTKGAPMGNPLSPFLSELFMANFESILKKKDLLPQRWWRYVDDVFSIIKKDYLPKILEAINSIHKDIKFTHEEEKDNKLPFLDLLITRESSHFEFEIYRKPTNTMRVIPSTSNHTYQHKMAAFHHMIHRMQTLPLSETGKSKELDYIFETARLNGYRNSTIQAVVDKRARDKYRKSMTTLTAEKEDLKRVAVNFDTKITQPLAKKFRKYGVDLVFSSRSSQLKSRLGSTKDKINKLNRAGVYKISCPHCNKIYIGQTKRTLEIRFKEHIAEVKKADKELEKGLAYDFKSKVAEHVFQDGHQMTSDNIDIVRSVSSSWKLDVAESLEIYKQKPSLLLNRDQGNGQSRLFKFVPKKYKRA

SEQ ID NO: 2792 - protein, 775 aa, synthetic construct
  source 1..775: note = Description of Artificial Sequence: Synthetic polypeptide
LDNFAFRGLKQRNLLRNHLDRTLDLIFTNDAITDCSSVDEACQPIVDIDPHHPAFVLTVRSPTIVPFVEVSDEEVRDFGKVDYETLHVLLSRVDWSTVYQCNDVDNAVSIFNGKLHECFTHCVPLAMPRRKPAWSNARLLYLRRNQSKMQRRFSKRKNDCNKLAFNRASRSYRYYNRYLYGKYVRRVQDNLRRHPKQFWSFVNSKRNETGLPSFLSLNGHSASSAEGKCELFASWFASVFDTSSQSQADPDAASQSLPTDIIDVDIFEVSHMMVEEALKKLKPSISPGPDGIPACILKHCKAVLIAPLKAIFNLSLRCQQFPKAWKMSYMRPIFKKGSRTEVSNYRGITSLPAGSKCFEIIMNDVLLQACKTYISQNQHGFFPQRSVISNLCEYTSFCIKEMDKGGQVDSIYTDIKAAFDTVDHSILLAKLNRLGASSRICSWLYSYLTDRQLLVKIGKAISAPFTPHCGVPQGSNLGPLLFVLFFNDVSHVLSNCYLLFYADDLKIYLIVRSINDCRQLQEQLDLFVSWCTLNHLSISVSKCCIISFRRMKSPVLYNYAINGTILNRVDNVKDLGVLLDHQLTFKMHYSETVDKANRQLGFIFKIASEFDDPLCLKSLYCSLVRSILEFASVIWSPYDAVWIARIESIQRRFVRCALRSLPWSDPLRLPPYEHRCALLGIETLEERRKMNQAVFGAKVLRSEIDSPALLRQLNIYAPQRVLRSRQLLYQPPRRTMYGSNNPIDTISRRFQDNYNLFDFNISTNTFKNRLRNRQV

SEQ ID NO: 2793 - protein, 746 aa, synthetic construct
  source 1..746: note = Description of Artificial Sequence: Synthetic polypeptide
SQHQRGGGVLIAVKKALQSNVILINDANQLEQISVRITYGTMSLVVCTVYLPPNTEPALYQQHAASVNQLCKLLGTQDEIVVLGDYNLPYLRWRFDDDIGAFLPINASSEQEISLVEDIVATGLMQMNHLLNSNERLLDLAFVSNASVCELLEPPLPLMKVDRHHTPFVLTLDVIQTPLENRKNETFFDFRQCNYDELNAEIAQINWRDILAFGSLDDAVTRFYSELNVIFERHVPRRSRACRPDNKQPWWNAQLRNLRNRLRKARTRYFRVRNRLNRDAVRDLESQFNELNVSCFQSYIDRLESNMKDDPKQFWSYLRSRTTSRGFPQLINYDGKTATTPDDAVKLFSSFFQSVLSITPPPSSASYLSALKTFDLNLQPTSFTQHEVYKKLCSIDGSKGPGSDGLQPSFIKACSASLAEPAALLFNRSLAESVFPAKWKEALITPIHKAGNVHDVKNYRGISILSCLPKVFESMLLDFLYPAVRHIITEDQHGFVRKRSTTTNLMSYVSTLIDKIEKRQQIDAVYVDFTKAFDRVPHQLAVEKFQRMGFPDWLTKWVLAYLINRSASVRLGTTLSDPFEITSGVPQGSHLGPLLFILFVNDLCSELKSSKVMYADDLKIFRVINSPVDCCALQMDIDKILDWCSRNGMDVNIAKCNVITFTRKRSPTVFEYSMHGATIERVRLVKDLGISLDCKLRFVEQISSVIAKAYAVLGIIRRNTKDFRDVYCLKALYIYHLFAAFWNMEL

SEQ ID NO: 2794 - protein, 873 aa, synthetic construct
  source 1..873: note = Description of Artificial Sequence: Synthetic polypeptide
HGGLAVFVRNELQMDVCRNIVIEGFHHIHCRFKFEANAINLHAVYRPPSFDVRRFLHEIEGMISLSKNNEKCVLVGDLNIPLNITTNNIVGEYIRLLETYNMLPTNTVVSRQSSNNILDHVVCSTSMIEDVFNETIFTDVSDHCLICSSINMKCHTSESTLHKRIIDHSRLNELFERSILNIPQNLSVNERLNYVITHYNEILNDCSRLVTQRVKLKGSCPWMTLDLWKLIKIKDKLLKKKRNNPNDNHTTELFAHVSKILQDKKAKTKRDYYEGLLSGNNQKAAWKIIKNVMGNQKSNSKPTAIRNGAQLITDPQQVCSSFNDHFCAVGPKLSSTINTNRNINRFGTLGSLQSTIFLKPSTRNEIILLINRLDSKKSAGPDGIPVSFIKHHHSFFASLLMETFNEIIVSGEFPDCLKIARVIPVFKSGDPKDMNNYRPISTLSIIDKLLEKLLVSRILEFSTKHHLIYGQQYGFRQGSSTLTACHELVDEIYDALDNKQIVGALFIDLKKAFDTVDHDLLLRKLESYGIRGIAKDLLKSYLTDRHQYVSIGEHKSQLRLVTTGVPQGSNLGPILFLLFVNDVARLNLHGKLRLFADDTAVFYRGTNCDTILNQIKMDLEVLLEYFGENVLSLNLNKTKYMLIHTPRRKIPAHGPISIGGHNLDKVYEHEFLGLTIDSVMSWAAHINKLKSKVSSLCGILRKISSFMPQTCLKQIYFALVHSRLQYVTAVWGSASKSHLRELQVLQNRCLKIVLRKPLLYPTVNLYSNRNDSLLPIKALYEYQVLVQMQKIVKGTSTHHNTVLHMSQQSRSSRQANHIFLFRPNSEFGKKKITYFGSKLYNALPENCKSFQNMFHFKRFVRNALKQKVEQFVL

SEQ ID NO: 2795 - protein, 766 aa, synthetic construct
  source 1..766: note = Description of Artificial Sequence: Synthetic polypeptide
VNDVVNENGRCLDLCFVSTQDVAPSIAIAPSALVKNVSHHPPLVLLLADSEPCEPLTISPVSYDFNRANQQGIVEFLASVNWLEVLDTNDVENAALTFTHILGHVIERHVPKKVHGTAGPPWQTQELRRLKTSKRAALRLYSKRGTQSHRNHYVSVNNKYKSTSRRCFRRYQQHIQQNLKTKPKSFWRYVNQQRKESGLPSTVKLDDEVASDRNQACRLFAKKFSSVFCDEMLSEEYVALAASNVPLVMETLNAFSVDDGMIARAATQLKSSINPGPDGIPSSFVKSYIEQLLLPIRHVFALSLTSGTFPSVWKNAIIFPVHKKGDRKDVSNYRGISSLCAISKLFELVVMEPLIAHCKQFISNEQHGFIPGRSTTTNLLSLTSHVSDSFTERVQTDVIYTDLTAAFDKINHLITIAKLERLGISGLMLRWFKSYLTERQLTVGLEGHFSETFTATSGIPQGSHLGPVIFLLYFNDVNYVIKGPRLSYADDLKMYLRVRSICDAITLQNDLDAFAGWCSLNRMVVNPEKCNVISFSRRKEPVYFNYQLFGKILQRVDHVKDLGVILDAQLTFKHHMSYVIAKASRTLGFIFRIAKEFTDVYCLKSLYCSLVRATLEYCSTVWHPHYQNGVQRIESVQRRFIRFALRRLPWRDPHRLPSYHSRCQLIHLETLQSRRDINRAMIVADLLQGRIDCPAILGQVDISARHRNLRANSMLRPPLRRTNFGQNVAINGLQRVFNRVAPAFDFHLPRHTVRRNFAEILTRRIV

SEQ ID NO: 2796 - protein, 913 aa, synthetic construct
  source 1..913: note = Description of Artificial Sequence: Synthetic polypeptide
NICHINVQSLIARNFTKFHELKLTFIDSKVDIICFTETWLNHTISNTMIGIEGYKLIRNDRNRHGGGICIYLRNSLLYKVVSMSQSSSNDFYGTEYLNIEIKVGFDKVLLGVIYNPPNIDCIDVLHDILENCTINYDCSFFVGDFNTDILKFSSRSRRFGEMLDAMSYECMNSEPTYFHQSGCSLLDLFITDSPDFVAKLDQISMPGVSNHDLVFCSLRLSLNRVEDIVQYRDYVNFDSSALLDGFYNIEWNNLFCMEDPNEILNFINYHILKLHDDFIPLRRKKKNRTPWFNSDISHAFINRNLAYDQWKRSRTEIDRNTYKRLRNFANDLVRQAKINHDKQNFNVDLPSKQLWKNIKKLGISNDSSFLDQDCLNANQINDYFISNYINDSSSVPIPFSSDGFKFNVFHEEDIVNSIFSIKSNAVGLDNIPIRFIKILLPIALPVYKFLFDSIIKTSVFPRAWKNSKVIPIKKKGNSASLSNLRPISILSSLSKVFEKLLKIQITKFITDNDLLHPLQSGFRQNHSTNSALIKVHDDIARVIDRRGIAVLLLIDFAKAFDRVSHSKLVKKLSSKFSFSHNAVKLIESYLNERKQAVFYNGVLSDFSFIESGVPQGSVLGPLLFSLFLNDLPASLEFCSIHMFADDVQVYLCASDDVDMNDFARKINHDLNNILRWSQNNLLAVNPSKTKAMLICKLKNRPLPPSIYFDGKRVQFYDKLENLGVIFTSNLCWDAFINGQCGKIYGTLKKLNLTTKHLDTAMKIKLFKSLILPHFIYCDFLFSNATASALNRLRVALNACVRYVFNLTRYSHVSHLQDVLLGCQFSKFYSFRACLQVYIIIKRKTPRYLYDKLQFMRNTRTMSLVIPNHSSAYYGQSLFVRGINNWNRLSPTLKSTANIYGFKGGLLRELERLQ

SEQ ID NO: 2797 - protein, 945 aa, synthetic construct
  source 1..945: note = Description of Artificial Sequence: Synthetic polypeptide
LRTKIDALYCNAIDCNYDVIILIETGLDAAINSVQLFGDNFNVFRCDRNAKNSTKSSFGGVLIAVHRRFTSSSISITTGESLEQVCVSVLVGNQRILLCAIYIPPDKSKDVNVMDEHIESVRELRNLSSGNDYLLVFGDYNQPELCWKRCGDEIRPTNSGSISAASSSLIDGMDFCNLHQMNIERNHLNRTLDLVFTSLELSPEITCSVAPLLPTDQHHPPLELDLMLPNGVNNVPTVSNATGELDFTKIDFEALSLFLSETVWHVLLDGLTADNMAETFCSVIANWLNTNVPTRRPAVSPVWGTPLLRNLKRRRNALQRRLRRHRSLENIRSFHRACDEYRELNSSLYKSYVLRVQSNLQRNPKQFWNYVNSKRKSSTIPMSVFLNDSVSSSPLEKCELFAAHFSSVFDAKPASPSEVDSAVSDVPRDLLDLDIFQITPAMVSQAAKKLKCTFSPGPDGIPSAVYCRCMSALAEPLCRIFNQSFVDSTFPAIWKQSFLVPVHKKGEKRNVINYRGITSLSAASKLFEMIVSDVILAQAKGYISIDQHGFMPGRSVTTNLLDFSTTCFEQLENGAQVDVIYTDLKAAFDTINHDILLAKISKLGASNRLSSWLLSYLTGRTLRVKVDSCMSSSFTSMSGVPQGSNLGPLLFLLFFNDVMLLLGHGCRLAYADDLKLYFVVRTVEDCVRLQALLDMFVDWCRRNRMTLSVPKCIVVSFYRITRPIMHNYVVNDVVLKRADSFCDLGVLLDHKLTFNLHRSNVIAKANRQLGFIAKISRDFTDPHCLKALYCSLIRPILESAAVVWTPYQLSWSLRLESVQRKFMRLALRNLPWRDPLNLPPYPDRCRLLDLDTLDRRRKTQQVAFIAKLMNGEVDCSRLLSMLNFRVAPRVLRGGALLQQRFHRTAFGSNEPFTSMIRLFSMFEDLYDFDGSSNQFVSRVRSSDLI

SEQ ID NO: 2798 - protein, 1058 aa, synthetic construct
  source 1..1058: note = Description of Artificial Sequence: Synthetic polypeptide
MTPKCNPVMSSNGQQPGRSVESLMEAPGPSDPVERNAVTVLHSRPGPAVGCGTGVFQSATSGEYSSIIDNAPSPSIVLNSRTCNARKMPISVNAKKSDDLLIYYQNAGGMNCDVDKYLLATSDDCYDIIVLTETWLDTRTISTQVFTPEYEVFRCDRNPRNSRKSTGGGVLIAVKKKLKANIIENDLWCSTEQLWVHVQFFGHSLFLCGIYIPPDRARDETLIETHLQSVTSVIEIAKPMDEIVVLGDFNLPGISWISSGNGFLHPDMNHSHVHSAASRLLDGYSTATLRQINHVTNENLRSLDLCFVSAQDVAPPISNAPSSLVKQVNHHPPLVLKLIVQHYSTSESIAQVTYDFTKADHEGILEFLAAVEWTEVLDTRDVDNAVSTLAHILGHVIERHVPKKTLASKGLPWQTRELRTMKTAKRTALRRYTKNPTPRMRDQYVRLNAAYKRTSRHCFNRYQQQVQRDLTAKPKSFWRYVNEQRKVSGLPPSLFLNGDVASEPQSVCQLFAQKFSSTFCDEVIPEVLVTQAASNVPLVNDSWATLTVDDDMISRAASQLKSTMKPGPDGIPSAFLKRHIDSLLVPIRHVFNLSLISGAFPSLWKNASVFPVHKKGERKDVNNYRGISSLCAISKLFELVVMDPLMTHCKNHLSDDQHGFISGRSTATNLIRLTSHIADSFAEGAQTDAIYTDLTAAFDKINHAIATAKLERFGISGNMLRWLHSYLIGRKLTVTIEGFQSNEFLATSGIPQGSHLGPLIFLIYFNDVHYTLKGPRLSFADDLKIYRRIHSDYDAMCLQQDLHAFASWCTLNRMTVNPGKCSVISFVRIRRPVVFRYELYNTVIQRVDSVKDLGVILDPQLTFKHHVAYVVAKASRTLGFIFRVAKDFTSVYCLKSLYCSLVRSTLEYCSVVWNPYYQNGSDRIESIQHRFIRFALRQLPWRDPLRLPSYRSRCQLIDLETLQLRRDIARAMVVADTLQGRIDCPVLLQSLDLNVRPRVLRNNTMLRLPFRRTNFGQQSAYIGIKRVFNRVASVFDFHLSRQTIRRKFKTVFLSFLDE

SEQ ID NO: 2799 - protein, 964 aa, synthetic construct
  source 1..964: note = Description of Artificial Sequence: Synthetic polypeptide
  VARIANT 168: note = Any amino acid
AAPASSNILMYYQNVGGINSSLAEYNRAVSDSCYDVYAFSETWLNANTLSNQLFDSSYIVYRQDRSASNSNKRTGGGVLFAVRSNFKSRVLNSPNGSSIEQLWVAITTVDATLYLCVIYIPPDRVNDESLIEKHTDSLDWVVSQLKPRDSIMIIGDFNLSGISWQYDXSGSLFPVASRSTISLTSRKLLDAYSTACLRQTVGIMNENSRVLDLCFVSEELRDASTVMQAPSPLVKTCRHHPPILLKMEICPQKRFHDVSESVFYDFRNADFNGMNDFFENVDWDDVLRDSDANLAASTISAILLYGIDQYVPVKVKREPSKPAWSNSELKNLKRVKKAALRRHSKFRTDSTRARYMQANTEYKQLNDCLYNAHQDHLQSILKANPRSFWKHVNEQRKESGLPPTMSDGLHEADSKEDIADMFRTQFSNVFTNEHVDPDIVNDAIRDVPRLSTFVQQIIITDDMVASASKELKSSTGSGPDGIPSLVLKRCAETIAAPLARVFNLSLASGVFPNCWKQSYVFPVFKKGSKQLVSNYRGIAALSATSKLFEVIILQKLVQSYAHYISPDQHGFMPKRSTTTNLACFTSFILRLMEAGQQVDAIYTDLSAAFDKMNHQIAVAKFDKLGMGNSMLLWLQSYLTGRNMSVKIGDHVSSPFRVWSGVPQGSHLGPFLFLLYMNDVNFKLKCLKLSYADDLKLYWTIKQPEDAVFLQHELEAFAEWCQINRMSLNVSKCSVISFSRKHAPFHFGYFLAGTQLERVSTVKDLGILLDSKMTFKDHVAYAVSKASSQLGFLFRYAKKFRDVYCLKALYCSIVRPTLEYSSIIWSPYYQNGIKRVEAIQRKFVRFALRHLRWRDPLNLPSYGSRCQLIKLESLVSRRNVAKACFVGDLLQGNIDCSTLLSCLDINVRRRNLRTHSFINIPSARTNYGLQEPMRSMSRVFNMCYHVFDFNVSRETNKSSYRRVLC

SEQ ID NO: 2800 - protein, 940 aa, synthetic construct
  source 1..940: note = Description of Artificial Sequence: Synthetic polypeptide
  VARIANT 197: note = Any amino acid
MRTKTNEFRTKMETCDYDIIVLTETWLRPDVVNAELASNYCIFRCDRNDNTSTLQRGGGVLIAVKSTLRCSAVELTDYIHLEQVVVAVRLPDTTIYVCGIYIRPNSHFDVYDSHASAVQEICNLSSTRDSIVVVGDYNLPHLTWHFDDDCNSYLPRNASSESEIMFTQSMIGSGLHQINSLRNMNGRILDLAFVSEXSFVELIDPPSSLLKVDSHHKPFVLRIEIETRTRAPVEEADVDDFDFKRCDFAALNDMLVAVDWNETFGDAPLDRITVLFYDKVFDIIRHHVPRRRRCSAVHSKLPWWTPELRHLRNIVRKARKRYFRNKSHDNRKNLKSLETRYSVCQENAFRSYTNRMESNLKRDPKSFWTYIKKLKNINRIPEELSYNGTTAETAEASANLFADFFSSVHNNHSPTFSSSARQNIQSFNVSLPMITISQHEVSSALKKLDVSKGAGTDCLPPTFLKECADSLKTPISVIFNRSLREQVFPEIWKVASITPIHKSGSVHSVENYRGISILCCIAKVFEEIIHRSLYSAVRPIISDVQHGFVKKRSTVSNLMSFTNVLSNSVEKRRQVDAIYFDFAKAFDKVPHELVISKLKHIGLPDWITEWLRSYLTDRKAHVKVGRARSHSYDISSGVPQGSVLGPLIFILFINDLAVRLKSGKLMYADDLKIYREISSTLDCCALQSDVNELISWCTENGMELNIDKCKTITFTRRQTYVTHDYAIGNNIIERVFSIRDLGVIIDSKLKFTEHISTVTAKGFAVLGFIRRNSQSFRDVYTLKALYCSLVRSVMEYAVCVWSPYHATHMLRIEKVQRCFIHYCLRQLPWNDPTNLPDYVSRCRLIDLETLTSRRTKIQRLFVYDLLSNNIDCSELTNELRFYAPTRQLRERQLLVIRPHRTTYGQNCPMSSCLRAFNDVGCYFDFNVSKCTFKHRIKYLN

SEQ ID NO: 2801 - protein, 858 aa, synthetic construct
  source 1..858: note = Description of Artificial Sequence: Synthetic polypeptide
EQSIVCVKLQKSSIYICGIYLRPNSQPVLYSSHSAAIQQLSERISRFDSIVVVGDYNLPQLIWQTDDDINGLLPSNASSEQEVTLLETMVASGFQQINNIVNSNGRLLDLAFVNDNNDVELLEPPTPLLRMDNHHKPFVLRIDVNDSCTQVGDSNHADDFDFRYCNFDELKSAIATVEWATLFIGKDTDETVCTFYEVLHRILDEHVPRKRRRRTHPFKHPWWTSELQHLRNIVRKSRRRYFQSRTVENRDKLRLLEASYIDCQTASFRRYVARMETTAKEDPSAFWTFIRNRKRVNKFPAEMAFRDTVANSPEGIANLFADFLENVHCTNPPTFSPDSLRNCPTFDLNLEPFDFAQQDVLSALQKLDTSKGPGTDNLPPLLFKECADSFQIPLTIIFNKSLQSRTFPMLWKTASVIPIFKAGSTRGVENYRGISILCCLAKIFEELVHNVLYTASQPLISQFQHGFVKKRSTTTNLMTFTSFLSTEIENKHQVDAIYFDFSKAFDKVPHDLAISKLRHLGFPNWIADWLRSYLTNRKAFVNINGTYSRVISVTSGVPQGSVLGPLIFVLFINDLCFRLKSGKLFYADDLKIYRTIASHLDCCALQADVNELELWCQENGMELNIKKCKSIAFSRRQSRTEFDYKIGSEPLERVESIRDLGVIIDTKVRFNDHISVINAKAFAALGFVRRSTNDFNDIYALKSLYCSLVRSILEYAACVWAPHHTTQIVRLEKVQRSFIRYALRQLPWSDPVNLPDYPARCMLINLEMLDARRNNLQRLFVFDLIMGNIDCPALLEDVQFYAPLRQLRERDLLQIRRHRTSYGFNNPLSRCFRLFNCASALFDFNVSKYVFKNRLKDF

SEQ ID NO: 2802 - protein, 816 aa, synthetic construct
  source 1..816: note = Description of Artificial Sequence: Synthetic polypeptide
GIYYRPPHQEEELDLEFSRELMEAACSRDMVVMGDLNYPDICWEEHLARSDRSCRFLTCVEELYLVQEVNGPTRGKALLDLVLAKGDDLVGDLRIEGNLGDSDHEMIEFTIRRRAGKSASRAEVLDFRKADFNELRKIVGETLWEEGLEGKGVQEGWSFLKGTILRAQKRSIPVCRKGGKGAGKPSWLTRGVKECLKKKKEAYGQWKQGVVTKEEYTSIARICRERIRKARAVTEIRLVTEIKDNKKSFFRYIGSRRKTKGNVGPLQNGTGQLITDSQEKAELFNEYFASVFLHANGGRPPGRILDGCGRGDCQPMVSVELVREHLERLNVFKSAGPDGLHPRVLRELAGVIAGPLAKVFEDSWCSGEVPEDWKRANVVPIFKKGRREDPGNYRPVSLTSIPGKILEKIIKKSICERLAEGMMLKDSQHGFVAGRSCLTNLVSFYDQVTNRLDVGDAVDVIYLDFKKAFDMVSHDALIKKLGDCGLAESTVRWVGNWLRGRTQRVLVDGSVSSWREVASGVPQGSVLGPVLFNIFINDLDEDVESTLAKFADDTKLWGKAVTLGDRMRIQADLDKLERWAERNRMQFNKDKCRVLHLGRSNQRHEYRLGGDVLASTMAERDLGVMVDHRMNMSRQCDAVVNRANSILGCISRCVASRAKEVILPLYSALVRPQLEYCVQFWAPHFKKDVENLERVQRRATRMIKGLEDKPYEERLRDLGLFSLGKRRLRGDLVAVYKYVRGEYRELGEKLFTRAPQGRTRSNGHKLLEDGFRLDVRKNFFTVRVTRIWNRLPKEVVQSPTLEVFKRRLDRHLAGII

SEQ ID NO: 2803 - protein, 977 aa, synthetic construct
  source 1..977: note = Description of Artificial Sequence: Synthetic polypeptide
SPPAGFKLGSSGEGEDEYGGSHGTPNQETPTRSAQVCSKDPIRQQFKGGPGTATRGIRCIYTNARSMGNKQEDLELLLASNNFDLVGLTETWWDSSHDWVVGIEGYRLYRRDRVGKKGGGVALYVKEQYTSSLIKLGSEGGQAETLWVRIQGARGERDLVVGVYYRPPHQDDELDQEFSKQLEEAVRSRDMVVMGDLNYPDICWEEQSARSNRSRRFLTCIQDLHLTQEVRCPTRGNALLDLVLATGDDLVGDLRIQGNLGDSDHQMIKFTIQRRAGIIPSRARVLNFKKADFNRLRGLVSRVLGAKNLDALRVQDGWTFLKETILWAQSESIPWQRKGGKGARKPLWLTRGIQDTLRAKKEAYRKWKQGVASKEEYTSLARTCRESVRKAKATLELRLASGIKDNKKSFFRYVGSKKRVRGSIGPIQDGQGGLVTDSRDKAELFNEFFASVFLNGNLDEPSTYITDTNKGNISRPTVSADTVKRHLEGLDVFKSPGPEGLHPWVMKELAGVIADPLARIYERSWCSGQVPEDWKRANVVPIFKKGRKEDPGNYRPVSLTSIPGKILEKIIKEHICGSPLANVMRRGNQHGFLAGRSCLTNLVSFYDKATNCLDAGVEVDVIYLDFKKAFDKVSHTILINKLRGFALDDYTVDWVANWLKGRTQRVVVDGSVSTWKDVGSGVPQGSVLGPVLFNIFISDLDEGVGSTLSKFADDTKLWGAANTLERRNQIQADLDRLGKWAESNRMQFNKDKCKVLHLGRKNCHHTYRLGGDLLSSTEAEKDLGVTVDSRMNMSRQCDEAVGRANRTLSCIRRCFTNRSREVILPLYAALVRPQLEYCVQFWMPQFKRDADNLERVQRRATRLIRGLQGRPYEERLRDLNLFSLSKRRLRGDLVAAYKFIRGEQHEVGDDLFTRAPPGMTRNNGHKLLERRFRLDIRRKFFTVRVARIWNGLPREVVLAPSLGVFKRRLDRHLAGIT

SEQ ID NO: 2804 - protein, 784 aa, synthetic construct
  source 1..784: note = Description of Artificial Sequence: Synthetic polypeptide
MGETILDFAMAYDLAIANTYFKKRDEHLITYKSGSHKSQIDLFLVKKVDRPSCKDCKVIPGESLTTQHRLVVMDVCIKTWKRRGESNGCPRTRWWNLKNEKIDLFRDKLVEEGKWNSEHDVNVIWNEMADCIKKVAKEVLGESRGKRNFDKETWWWSDEVQKAISEKRSCYKTWQCNRNDQNLEEYKNAKKNAKQIVSKAKLKAYDNLYNKLGTREGEKDVFKLAKIREKKCRDLNHIKCIKSEDQRVLVKDDEVNERWRVYFQKLLNDEHNGNIVVEGTVGTSEGGGHRYIRRIRMSEVKEALKRMKIGKALGPDGIPIEVWKCMGEIGIDWLTKLFNKVLRTKKMPDEWRKSIVVPIYKNKGDIQNCANYRGIKLMSHTMKLWERVIEQRLRHETSVSENQFGFMPGRSTTEAIFLLRQLIEKFRAKGKDLHMVFIDLEKAYDRVPRDLIWRVLEKKGVSRHYIDLVRDMYDGALTSVRTTSGETSEFSVTIGLHQGSALSPYLFVLVMDDLTRHLQDEVPWCMLFADDIVLIDETRNGVNTKLELWRDALESKGFKISRTKTEYMECKFSNNRSRDEEVVKIDGQEVQKRPHFRYLGSIIQENGEIEEDVAHRIRAGWAKWRCATGILCDRRIPMKLKGKFYRTAVRPALLYGAECWADKKQYTHRMSVAEMRMLRWMSGKTRRDRIRNESIRENLGVAPIGDKMRESRLRWAGHVWRRPSTTPVRRCELVQVEGLKRARGRPKRTWLEVVRKDMGTYGLTEGMAFNRAEWRTRIHVADPN

SEQ ID NO: 2805 - protein, 967 aa, synthetic construct
  source 1..967: note = Description of Artificial Sequence: Synthetic polypeptide
MFINPIPLCALPRPKWSIHRRRNLSNMIYPPLSTPQEFTVTGGLWNCQSAVKKADFITAFAKTKSLDFLALTETWITPDNTATPAALSAGYSFSHTPRASGRGGGTGLLISLAWKFCVLPSPNPTSSSFESHAITVTHPSKFHIIVLYRPPGPLGSFLDELDTLLSSLPEDGTPAILLGDFNLSPETSQLSRVASLLQSFGLSLSSSPPTHKAGNQLDLVFTRSCSIPQLTVTPLHVSDHFFLSFPLSYLHPLNSSNSSPTVTFRRNLSTLSQSSLISTALSTLPPPASFSNLPVDLATSTFNSCLSQSLDSLCPLVSKPARSSPPCPWLTESLRSSRTSLRAAERKWRKSRSSDDLTAYHTLLAAFTSALTSAKASFFQSKISACVSNPRKLFSTFSSLLTPPPPPPPSSLSADDFLAAFEGKVATIRNSFAHPVSPPPPRDRPTATLTSFEMLEDSDVLQLITSHRATTCPLDPIPSKVLQSISSEFLPYLSSIVNSSLSSGHVPSDFKMARVTPLLKKPTSDPSDVTNYRPVSLLPFLSKTLERAVLKQLTSFLHQNNLLDPHQSGFRSGHSTETALLGVTEALATARASRLSSVLILLDLSAAFDTVNHKILLSTLAGMGIAGTALSWFASYLADRTYQVTWKGSASASHPLVTGVPQGSVLGPLLFSLYTRSLGSVINSHGFSYHCYADDTQLFFSFPPSVTQVNDKISSCLADISTWMASHHLKLNLNKTELLFFPCKTSLLRELSITVDGTTVTASHSAKSLGVVLDDQLDLKEHIKATSRSCRFLLYNIRRIRPYLTTHSTQLLVQATVTSRLDYCNSLLASLPACAIQPLQMIQNAAARLIYNLPKFSHVTPLLRSLHWLPVAARIRFKTLTLAYTAANRTAPIYLQDMIRFYVPARPLRSAEAGRLVTPPTRPKGSQSFSTLAPQWWNELPVPLRTSPSLPIFRRGLKTHLFRLYLD

SEQ ID NO: 2806 - protein, 1148 aa, synthetic construct
  source 1..1148: note = Description of Artificial Sequence: Synthetic polypeptide
MVKQTLKKSILARSSPRIIRTTASATPGHLSTSGLQEPGPIAEQPGHGPVGQLEAKQLQKWQKFSMPQNRTVMNCYYRSEPQKRGYQKRMYQLWKLEYPDSTVTEQRLADQRRYITKKKVLSEVELEEIKSNCETEEQTTVETAAEDLMTSEPTEHMEPEENAGIFQDDEHEEPVAIAYTTPGTLTMKQQELKENFLTHAALKEGRQRLPTLKTVPRKHLAPLMNDVNAALATVEITTMEETNQLAYSTAVIVTQELGIQQLKPARKMIGKPKWKIRLELKIRSLRSDASNLKNMKEQKLKNVKTKNYLIKKYWLNTRKIEEALEIVKQQITATARKIERYEARVIQYKQNQLFQSDQRRFYQSLNQQVAVKNEKPEKTATNAFWKDLWETEKGYNKKAEWIKDFENKFSENKMRTLEITTEMITERVKKVKNWTSPGNDQLHGFWLKYLSSLHSKMAEQFNEMLQTGNISKWITTGKTYLIQKDPAKGAIPGNYRPITCLPTMFKLLTGIIADQIQDYLEENNILPVEQKGNKRRSRGTKDQLLIDKMILENCKSRKTNLYTTWIDYKKAFDSLPHCWIIKCLDVIGVCENIRKFTENAMKQWKTELFVGNESYGTVNIRRGIFQGDSLSPLLFIIAMVPLSVILQKTNLGYQTARNSPKISHLLYMDDLKLYGKSETEIQSLTNTVRIFSTDISMEFGLDKCATVALKKGKITHSEGIEMPNGQTIKCNQPEAYKYLGILQLDNIKHGHVKNVVSKEYIQRVRKVLKSKLNGGNTIKAINTWAIPVIRYTAGIVNWTQAELDDLDRKTRKLMTIHYSLHPRSDVDRLYLPRKSGGRGLLQVKQTVEEEKHALADYVKGSQEPTLREVNSSKLLQVQKTKSEYHKNTIQSRRENWRKKALHGQFLGKIESQIDKEKTWLWLTNGTLKKETEGLILAAQEQAIRTNAIKAKIEKSTTDPKCRLCKEADETIDHILSCCKKIAQTDYKQRHNTVAQMIHWNLCHKYHLPATKNWWDHKPEKVTENEHVKLLWDFRIQTDRVLEHNTPDLTIVLKDKVWIVDVAIPGDSRIEEKQLEKLTRYEDLKIELQRLWHKPVKVVPVVIGTLGAVPKDLGLHLNTIGADKITICQLQKATLLGSARIIRRYITQS

SEQ ID NO: 2807 - protein, 847 aa, synthetic construct
  source 1..847: note = Description of Artificial Sequence: Synthetic polypeptide
  VARIANT 507: note = Any amino acid
MGIECIGLTLAIRESVTILLVYRAPGAPNENIPKLLDLVADWALKFPSLIVLGDFNVHADRLLSSSIARDLVQSMETIGFSLMVTGPTHRAGHTLDLIFSIGIQVTLSSVLEIPWSDHYILNTQIKSSPPQHPETEQIFARPRKLMDPIRLSSVLKELDYTADSLHERVENWNKNLSTALDIVAPKRAFRPRRNRSPWFTDALRQMKLERKRLERKWRKKPDETSKLALETHQKIYEAATREAKKEYNSSLIASARSRPAQIFKIVRNIINPTHPAKDMASQDITAETFQSYFINKINLLREGLPPTEDTLRELEAFWPSSDKLLELFVPLEMEDLEKTLAAARPTTCSLDPCPSRLVKECWEGLRDPLRDIINSSLEQGIFPECLKEAVVHPLLKKPSLDAAIPSNYRPVSNLPFLSKVIERTVAGQLQQFLDETAGLDPFQSGFRSGHGTETVLVAITDEIRRQLDRGGSALLVLLDLTAAFDTVDHDLLIHRLAMSGVRGLALXWFNSFLRDRRQRVEWSGQSSESSCLCCGVPQGAILSPLLFNIYVRPLAGLVRSFGIECYQYADDTQLLLRLEPGTTTIPENFKLCLEAVMSWLRASRLKVNPAKTEILWPGQPPELIQSLPDFDGEVLVPSATVKSLGVVLDSSLTMEAQITAISKQAFFHLRQARKLASYLSTEALATVIHATVTTRLDYCNALYAGLPKTKTQKIRMVQNAAARLLAGSSIRSHITPILKQLHWLPIEHRISYKILILTFRARNGQGPLYLRDRLIPFFHQWSPRSSQENLLYVPGPREVHLEATRRRAFSTYAPILWNSLPPYVRAMSELRPFVKALKTWLFGCAFK

SEQ ID NO: 2808 - protein, 846 aa, synthetic construct
  source 1..846: note = Description of Artificial Sequence: Synthetic polypeptide
MPAIDVGETSGENASGTWPHSPKDIQQPCDPGHESLRQHIEHLYGEKLFQDTRRLEKLRTRKAHLLCSLTFLLRCRDTDTIPQFLAAKRTFKTPQAHRIYNRLERNLLRERIHTIRKELANTDKELLHLHINISQKMNTQDWDKIDSLTYKKMEKDMVLHTKRQKQKFDKCRKQQPKPELDKSRTIINLTDRQLTEDQVSILEKGGNFAVTTTRIPVENIIANVESAIYQLPEEEAEEVRMETARILRNAKLPPSNITRKERQAIKDLNSDPEIIILPADKGNATVIMETKQYKEKIRQLLDPTIYKKLKQDPTNKITRKTNTLIKNSSINFDIRQQLCKSEALPPRLYGLPKIHKDSIPLRPIVSAIGSPTYNLAKFLATQLQTHIGLTAHYIKDSTHFIEKISNLNLSTKDILISFDVVSLFTKVPVADTLTLIKQNFPEDITALFHHCLTTSYFQWDTGFYEQKDGVAMGSPLSPVVANFYMEYFEKQALETAPKKPTVWFRYVDDTFTIWSHGEEELSKFLDHLNSIHPNIQFTMEKEKEGKLPFLDVLVIRKPNQQLGHTVYRKPTHTDRYLHKNSNHHPSQKRSTIKALTDRAQRICEPHLLQGELNHLNWALQANGYSTTDIRRAARPRTSHESQDKDPPRGKVFLPYIKGTTDRIGKLMKKHNLQTIYRPTKKIQQMLRSAKDKRDPLSSAGVYRIPCSCGQVYIGTTKRSAQTRVKEHERHCRLIQPEKSAIAEHLMNQPGHRILFENTKMLDHSNNYHVRLHREAIEIHKHVDNFNRKEETMKMNKIWLPVLQNSKIKTVNKKQYSENRGFPDMNQPRAVNDSKQRMPQRQEEDSR

SEQ ID NO: 2809 - protein, 972 aa, synthetic construct
  source 1..972: note = Description of Artificial Sequence: Synthetic polypeptide
MTIISINIEGMSAAKEQLLYELCRDKKCDVLCVQETHRDKQQKRPKVPGMILVAERPHAQYGSAVFVKPGLQVSSVHNTEENNIEVITVELNNITITSVYKPPNEEFCFSSPENFDSHQRTVVIGDFNSHSHVWGYAQEDKNGEAVLSWAELHKLSLIHDSKLPPSYNSGRWHRGYNPDLLFVSDSIVQQCSKSVGPPIPNTQHRPIVCQLFPTIRPLEVRFKRRFNFRKADWSKFSDMLDDKIISVAPIPEEYERFIKIVKTCSRASIPRGCRTHYLQGITPDTAALLEDYYRLHNEDPFSEQTLQTAQSILSSISEAKKEQWIKLITEVDMGRSSQKAWRLLRRLSNDPSQTNTHANIKADQIAHQLLKNGKPKLSTKVGRKPIVRQPDNENNHLHEPFTSTELDMALNKCKNGKAAGLDDLRMEQIKNFGPKARCWLLKMMNNCIASCQIPKIWRKARVIAILKPGKDRNDPKSYRPISLLCHLYKVLERLILNRIMEKIDPCLIPEQAGFRKGKSCTSQVLNLTQHIEDGFERQQITGAVFIDLSAAYDTVNHRLLLRKTYNITKDYHLTRFIGNLLQNRSFFVEFQGQRSRWRKQKNGLPQGSVLAPSMFNIYTNDQPLPEGTESFIYADDRAITAQAGSFEMVEQKLSEALGALTAYYRENQLIPNPSKTQTCAFHLKNRQASRALRITWEGIPLEHCSTPKYLGVTLDRALTYKKHCFTIKQKVGARNNIVRKLTGTTWGSQPDTVKTSALALCYSAAEYACPVWNTSHHVKTVDVALNETCRIITGCLRPTPLEKLYCLAGIAPPDICREVAANNERTKALTSPAHPLFGYQPARQRLKSRNSFLRSTEILAGTPQQARVQKWQAKTRNLNQWLTPDERLPPGHTEDWATWKALNRLRSGTTRCRANLKKWGYKVESATCDCGEEQTTDHLLQCILSPATCTMEDLLTATPEALQVASYWAKDI

SEQ ID NO: 2810 - protein, 1355 aa, synthetic construct
  source 1..1355: note = Description of Artificial Sequence: Synthetic polypeptide
MEGVCCDCSVPLESLECGIMCSFCDAVYHSACTKSPFTVIEEVKRTASLHWSCVGCSNALGNPHSKAVKTTGMQVGFQAALTAAVEVMKAALVPPVMHEIREGFASFAAAHQAPSEHFNVPPPDALPSGKRRRLFRDVVASTEAIVVDNAPLYPVNTDTDNTHQRNRPSLPPIITGTDTTTTSIPTVSQLPRTNYMWLHLSRLAKTVTVDQVVSMVKSQLDTTDVIAFSLLKAGTTISSVSSLTFKVRIIAALRDKALTAGSWPVGLGVREFISLPQRPSHHRPDLTNTNTPIPVRHSPMHPVQLSPDMNCTLISPAPQKQLQPHQTPLKCTKLLFNTFFLSNNHTTVSSKGTVPLNLTSHLFTRNNNTSTTRSLTDDLAPTYTRIPLNVRSTSITVYYQNVRGLRSKADEFRLTVLEADYDVVVLTETWLDPSLPTALLFGDAHCVYRCDRNAANSSLSRGGGVLIAVSSALRSHALPVLAQTLEFACICIQLPTYRLYIAAAYLPPNHSTDEGKINALLDTVNSICDTLGPNDRFVLVGDFNQPALSWSPAQSNHETPFVFFEPHTSSVRSAQFVDGLHQNALYQLNNNTNSMGRILDLAYGNWSSAATSSLIRVSEHPLLPIDCYHPPLEFDLEITASSMNHATTVTEIKLNYARADLTKLKRLICSFNQSFECSNYTSIDHATNDFSEFMRAALRECAPIKKPHRGPPWGDRTLHALKKAKRAAYDYLRANRSTPCRLYYNGAHALYRRYNRVCYRRYIRQTERSLRKYPRRFWSFADNMRKSTGLPGTIRYKDNCAHSPLDICELFATRFEDSFISNITPPEAVASALVNTPADAIHVTLPIVTETLVTQKIERLKSSYSEGPDGIPATILKRCAVSVAPVLTKIFNESLRTGTFPSLWKVSWLTPIHKKGSKNEAVNYRGITSLAACAKVFELIIYEPLMASAGKYISTNQHGFMPKRSTTTNLMQFVSGCYKSIDDGMQVDAIYTDIKAAFDSVSHNILLAKLDRLGLSPPLVKWMKSYLCGRSYAVRMGSHQSRSIGASSGVPQGSNLGPLLFLLYISDLCTALPDNSCLLYADDAKIYREIREPEDHLQLQATLTEFVSWCKRNALSVCIDKCAIISFSRSRAPALFNYTLDGQNLERVNCVKDLGVLLDAKLSFEEQIDQVVASGNRLLGLVINMTRELRDPMCFKTLYCALIRPLLEYASIVWWPASTRALARLESIQRKATRFALRDWPRRLDYRTRCLLLGIPPLAERVEHTRLAFITGILNGTIDCPELLSRIHLYVPARILRRRPMLAVAETRTTFGSRNPLLCMCRLLNSANDIYEPGMTITELTSLLSVRNAFNNNNI

SEQ ID NO: 2811 - protein, 1064 aa, synthetic construct
  source 1..1064: note = Description of Artificial Sequence: Synthetic polypeptide
SPRIPRIFGLQCSPGFSSTTAAAIPSQAINRCDPRTRITSVYPYRFSAANFPPVDEPAATTAQSNSTSTPITPLHHAAERFETLPSVASPITVSAPLPLHASFPHPIDDLRFYYQNTRGLRTKLDDLRLASADTEYHVLILTETWLSENIPSSLAFDNNFVIYRCDRNSRNSSRSRGGGTLIAVSRKLAACEISPASDSLEQCWIRLKLPSCSLFIGSIYLPPTLSADASTLNTLDASIDEIISRMKKNDRLLLFGDFNIPSITWHASPDPAPPFLPLLVPASSAHSSSLFIDIVRYHSLSQLSSVSNFRQVQLDLIFTFPKNQSNATSTCTYVSQAPVPILQIDPHHPPLELSLKITGSLTPSNRSQHSSSRLTTAPSLDFRKTDFNLLNTSLSNIDWSQLYSCKDVNLAVSTFTSLFLSTLPQCCPKRNPPRSPPWSDATLKSLKRDKSRYQRAYWSTRSVNALRTYKYAAAAYRLYNRTRYNGYILILQTRLRWYPRAFWKFMNARRKGSSLPSTMHLESVYASSPEDICSLFRNHFSNIFSPPSQIPNTASQCLSYTPQDVIDVSCFGFDEHSVSEALSKLKPSFSAGPDGIPPSLLKKTAEVIAPLLSFIFNLSLRLCCFPSSWKSGWLCPIFKKGNSADVSNYRGIVLLPACSKVFEIAVHSVISFQVKSWISVNQHGFMPSRSTVTNLMQFASHVIPSLDSGLQVDTIYTDFKAAFDTVPHHLLLLKLKKLGFSNMLIDWLYSFLNSRSIRVKTDTTFSSSFCPSSGVPQGSVLSPLLFVLFVSDVHAILPSEGHLLYADDLKIYLTISTHSDCLRLQEFLNSFSLWCSYNQLSLCPEKCSVISFCHNRNPIHYEYSLSNSVLSRTSLIRDLGVLWDDKLSLNEHLESVVASASRTLGLICRLTRDFRDPLCLKSLYCSLVRSTLEYASVVVGPVRSGWILRFEKVQKRFTRFAFRRMAGPNAAMPSYESRCNLLGLESLEVRRSQARVLFIGRMLNGLIDAPTLLEKIGLYAPSRNLRARSALNMVSRQTTFGSNEPLLLCVRTFNTSTDPPHPRL

SEQ ID NO: 2812 - protein, 536 aa, synthetic construct
  source 1..536: note = Description of Artificial Sequence: Synthetic polypeptide
MPSPIVDQTVISRATSYTPLNMIDYTIPTFDIRTVEKCLKSLKPSTAPGPDGIPSYIISKCYQSLAPVLTNIYNTSLSSGIFPRLWKTSWMVPIFKKGDRSCASNYRGITSLCAVSKAFELLLYGPMLSATSNYIMDNQHGFVPKRSTLTNLTEFVSFCKRNLDSGGQVDAIYTDLKAAFDLISHDILIAKLQKLGFSEQIVKWLHSYLTERSYKIKVNDHTSREVLGTSGVPQGSNLGPLLFILYINDVGQLLAEHRFLLFADDVKLFAPINDTNDCINLQHAINLFSIWCRDNAMVLCIEKCRVLSFYRSRSCTRFNYQIDNISVERTDTFRDLGIILDTRLTFNDHLENIVSRGNQLLGWIIRSTQGFRNPMTIKTIYCAYVRSVLEYGSIVSDPCTEQWSNRIEAIQRKATRYAVRLLPWRQGDVLPSYHSRCLLLGIQSLKKRREIAKCLFISGLLNHHIDAPTLLATIEFNAPSRNLRTRQFISVPRYRTRFGQSDPMSAMCRTFINNFDLFDFNIPQNVFRDRLRTQLT

SEQ ID NO: 2813 - protein, 1008 aa, synthetic construct
  source 1..1008: note = Description of Artificial Sequence: Synthetic polypeptide
MMQGGESRKEAAGQKPPPSSKSKSLRIGSWNVRTLYEAGKTAQVLQEMHRYQLHILGISETHLNQSGQKRMKEGELFVYSGNDSDGPHREGVGMIISKTAQKTFRGWEAHGPRIIMASFGTKKELKVRDGRKKVINMNIIQVYAPTNDAEVENKDDFYNRLQNVIDKLPGKDINIVMGDLNAKVGSDNSHNEEIMGRHGLGEANDNGERFQNFCTFNNLVIGGTIFPHKRIHKATWVSPDGTTENQIDHFCISRKFRRSLEDVRVLRGADVASDHHLILGKMKLKLRRYAQVAAGNRLKYEVSLLKDPVKKNEFKLELKNRFQALQDLDECEVNEHWDKLREAVNATCQSTLGPKDNTRNEWISQDSLDKVKRRRELKAQVNNSRTRTEKLAAQQEYTEVNREVKNSIKKDKNTYLNGLAEKAEKAATDGHLRIVHQTTRTLSGRFSKPTLPVKDKEGKTIFNPEGQLNRWREHFDQLLNRPPPENQPEILPARNDLPIDTEPPSREEIAAAIKTLKSHKAAGPDHIPPEALKAEKDTFVEILYALFEKVWQKEEIPSDWKEGHLIKLPKKGDLSNCNNYRGITLLSIPGKVFNRILLERIKLATDEKLRGNQAGFRKNRSCVDQIATLRIIVEQSLEWNSPLVVNFIDYEKAFDSVDRETLWKLMRHFGIPEKIVKLVKATYDGTSCQVFHEGQLSEPFRVQTGVRQGCLLSPFLFILAIDWVMKEATRGKRNGIQWIPWQQLDDLDFADDLALLSHTHAQMQEKTKELNSLSRSVGLRIHPGKSKVVKLGKVSNLAVTVEDTPLEEVDSFTYLGSVIDGKGGTEADVKARTAKARSAFKQLSKVWKASNISLRTKIRLFNSNVKSVLLYGCETWKTTKTVLNKVQTFINRCMRSILRIKWQDRIRNEELWERTGQKDIEVEIGLRKWRWMGHTLRKPSGNITRQSLQWNPQGARGRGRPRETWRRCVERDMREMKLTWNELGRMAQDRDKWKELVCGLYPARGERH

SEQ ID NO: 2814 - protein, 935 aa, synthetic construct
  source 1..935: note = Description of Artificial Sequence: Synthetic polypeptide
MSLKSMVEIYQPDIIAVTEVKPKYVRFKIQESELSLDGYDYELFHNLEEEGRGLVLYVRKALKPGLCDDLDNDFCEKRFVKCVLKDGVSLLIGLAIYRSQHSPTAEEDARKLNKLFELVSLRKETHKIIMGDFNFRQIDWETETSNAGEKHIATKFLKATKDAFFIQHQKTPTRYRKGETPNILDLVFTNTEQLVTDIKVEAGIGKSDHLCLLMTLSLSAGTAPKVTRRNFRKTDVEKLREDLGAYDWESELANKNVEDTWSVIKSKIEGAIGASTPLMNISGRKNKRYMDKDTLEAVRKKHRAYRKWHRTGKTTDEIAYNKANNKARKACRKANRNYEKKLAIEAKKNPKVFYSYANSKIKSKTGIADLNKDDGTKTKSDTEKAELLNKFFQSIFTNEDTGPLPDFEEYDYNTELQDFNIETVTVKELLVSLDVNKATGPDGIPPRVLSQAADILALPLRILFRRTLNDGVLPVEWKTAFVSPIFKKGNKAAVNNYRPVSLTCVICKVMEKLVRGHIMDHIVNNMLISKDQHGFVTGRSCITQLLEALDDWTSVMDEGGSVDVIYMDYQKAFDSVPHRRLIQKLSACGVKGRVLKWVRDFLTSRKQRVVINGSRSEEAEVTSGIPQGSVLGPLLFVIYINDLPRGLKTTAKMFADDTKLYVRSDTVNGPQDLQDDLDTLQEWSQRWLLRFHPQKCCVLKVGKDNDNEYFMDQAVDGSTSRHKLNVTKREKDLGVVVDNKLTFKEHVAQMTSKANRIVGLIRRSFDYLSEDMFVLLYKSLVRPLLEYAHCVWQPFEKGLCSEIEQVQRRATKMLSHLKEKPYSERLKKLKLPSLEHRRLRGDMIETYKYIKGYYITERPAFTKATTTQLRGNSEKLQKQRSRLCVRANFLENRVNTIWNNLPESVVSAPNVDTFKRRLDEYWKDLPTIYNPTCQN

SEQ ID NO: 2815 - protein, 1202 aa, synthetic construct
  source 1..1202: note = Description of Artificial Sequence: Synthetic polypeptide
  VARIANT 96: note = Any amino acid
MSIRIASLNCRGLNKKLKRRAIFRKCTQYDIICLQETYVTNTTAREWSLEWSGDFFYSEGTNKSKGQIILVNKHFKYKTVELCIKTERILGLSFSXDDVSYVAINVYGPVVKNDKLDFIDKLYSVLKDEKADHTIICGDFNVVHNNTLDIVTGEKHDDMSTQKFRDWIANCQIVDTWRGVHGEEKDFTWSRPTPFTARRLDYIFCNTELFPFVIDSKHAFVYGTDHKAVITTVRTEKFKRGPSYWKFNNSLLKDKEYVNSMEKCIDEYLERTLDETDKTIRWELLKVMIKSHTIDYCIRKCRALKLRENLITEELLKLNDQVVKNPQDLTLLKQFESKKKELEIYQLHKARGAQIRSRQKWIEEGEKNTKYFLRMEQMRGGSNVITSLQDDKNNNLYGHVDIVDSIKNHFERLYKKDHNIETNRVDDFMQGCSFPVLDDVDKEICDSELSIVELDAIVNKLNIDSAPGIDGITTPFYKFFWSKLRKPLFTNFQQCLETGELSPTQRRGVISLLHKGKNLRRDNIKNWRPITLTNTDYKIFSKILAIRLQRVMPVLINENQTGFLKGRSISEHIRTLDDIIYVASEKNLPGMVVSLDFQRAFDTVEKGTILATLKKFNFGEGFINMVGVLMANTECCVQNGGWLSEWLNTERGIKQGCCTSPLLFVLVAELMSIKLRNNSSISGMSTILSGEIINFCKVLQYADDTTLILKDQEDLASALLDIDSFGSISGLKLNKDKSQGMWIGSDRTRTEKLGGISWVPNGNTIKILGIHFSATEEASRIELNWIDKIENMKNIMKMWMKRNPSLYGKVIICKTFLLSQISYIIQSLSLPERVLNTIDTLFFKFLWQKRHSNKKAREKVKRTVMCRSIEEGGLGVISVKDQQKVFLLNWLKRMATVTEGRPNNIPNRISDLAFTEVGGCDYFFSATANCKKTGKLCHASKFWESVMDTWIEMASIKKEPSSTIEILMEPLFNNRNIKYKGKSLYLKRWMNSGIKYVYHLYDRRILKSKEELSHITGTYAAFDFDYYALMNALPTQWKQDVSDNNTEELLVNTREVINTNGKKTVLEILSKSNREIRQLLKYRRHAEICGRNFWMRKMNIDITCKYNIAHRSTKESRLRLLHFKILHNIFPSNILLNRLGIKNTELCEHCGVKDVIEHMFIHCTLLKNFWKYVFHTICLKTSSRFPMTDCNILFGFSERGQG

SEQ ID NO: 2816 - protein, 1095 aa, synthetic construct
  source 1..1095: note = Description of Artificial Sequence: Synthetic polypeptide
MDNDLSVKRTMQKENQENSFMCEQCYRKFDTWRGLRVHQGKVCLKKRRQCRSSDCKTRSKSSQDENHSGAISASVDSPFTLSQQEMEQQTEPGLRKPRILWPAANEKAKYKTLEEEVQKKLKEVKKSSNRGDAKEILSAFATIIYDSAIKEFGICEGKKKTEKKSGLSRRQRVLAQLRKQKRDLQKQKKYAPPEEIEGLRILFEDLKKKSRDLQRHERRCTRRKERKREREQFLKNPYEAAKKLFTEARSGKLECTKEELDAYVKQTYSDSRREEPLPYMRGLKRPAAPVVKYYLGPIREKEVDEFVKKARAKSAPGGDGVSYKVFKYCDTLRHTLFEMLRGLWKDKEIVKDWCRAEGVYLPKEQNAKEIGQFRPISIINVTCKIFMGILAKRTVAYLQSNGYVDETVQKAGVPGIPGCIEHAFTIWDTIQEAKKNKESLNVVWLDLANAYGSVPHKLLMKAMDFFYVPQEVQNIMREYYSNFQMRFSTANFTTEWHRLEIGIAAGCSISVIWFILVMEMLLRSAECCEEEAKVRSPKKAFMDDVTLLTRDGDTMQSVLNRLDKLITWARMKFKAKKSRSLTINKGKQKQLKFTIAGEQMPTVKEQPVKSLGRWYSGTLSDRSQGVEIMKQAENGLKAIDQTKLPGKHKIWCLQFALYPRLAWPLTMYEVALSRVEMIERKCNSYIRKWLGLPRTINTSSLYRHRGALQLPLTSIVEIYKAGKIRTVLMLRESRDKEISGKPPDVKTARKWKAEVAANEIISALEHGDIVGPAQPDRLGLGNGDFRPFRKMSQRDRRKAATRHMQKMEAERREIHLIQCSQQGQMTRWEEHVVERKVGWSDIWKWNTSRLSFLLRSTYDVLPSPVNLVRWKVREDNKCRCGKLGTMKHILSNCNLALNRYTWRHNEVLKVLTKMATQQVEEGKYAPKIQKHGPTKIAFVPQGSKVAKRKKANEAMKDQSGGTWEVAADLKGFERFFPIPTTKKPDIVLWEEKDKEVHLVELTVPHEDNIYAAHERKENRYEALVEQCEEAGWKATHFPVEVGCRGFVATSARKWMRVAGLTAKKSNELTNSLQETAEKASHWIWLKREDSSWNES

SEQ ID NO: 2817 - protein, 1101 aa, synthetic construct
  source 1..1101: note = Description of Artificial Sequence: Synthetic polypeptide
  VARIANT 216: note = Any amino acid
MLFTNDRIPYELRRRLGNQGLPQVLVGNQAGLVDGYWKKKKIRKQRKWKNKKKTPPTTGNGKEKLIDFNILQANVCGLDKKKTQLGKILYERKVHIALLQETLHSSCDINITGYTPYPCKCEGCQGIITYIRNDIQGEVELLNWHPTDAHKVTLWYGNSKLILYNIYCPPSSTLNFLEQSTIFKKTVIAGDLNGHSPLWGYADQNNTGKRIEELCXSSNLILLQDEDSTKTLLHRRHGTLHRPDLTLVSADLHNYCSEEVLDCISSDHRPVLTKISILKHRQRKRRTRWNFKKANWDLFRKTAEDTVKLDDLDNKSIDALNSELTSTILDAAKKSIPQGCRTNYKPFWNERLEKATKTKNDARHEYEKDLKNMDKKIRYKKAVAEAKLVTKESKKEAWTQKCEGLNLHQGGREAWSLLNNLTGEKRKENPKPLHTETEVLTSELKKAEHFNKHFASINKSSKRNDLDRGLLSVLKGKERDLMTPSIFQDFLTKRELDCAIKKLKKRKSPGPDKVHNEMLQNLGEKAKLLLLKLYNRTWTEGNLPKAWKLATINPILKKGKKANDPKNYRPISLTSCIGKLCERILNSRLYWWLESSGLISQCQAGFRSKGRTEDQLFRLTQKIIDGFQRGEQTTAVFVDLQQAYDRVWRKGLLLKLQNMGIKGNMYSWIKSFLTDRLIQTQMDETLSSKAVLEEGLPQGSSISCTLFLVFLNDVSDVLKTEKALFADDLVLWHTGNSTTISRRRLQDDLNSLGTYCRLWKMKVNCEKTVYSVFTRSYNLANAEIPLKIDGTNLKKENNPVYLGVQLDSKLNLKQHTNNLRKKAMKRLNLIKRLASTNWGSDKNTLRGLYLGYTRAVFDYNLVLQNICSKTTKNSMDTIQNQALRLISGGMRSSPTAACEIHTNIEPLETRRKRAALEVYERSKRLENNHPNRVLVDKWKPNQRLKNTKSVLDTVLNLQEKHHLPERREPLERVPSTLPPHLTIAKPEIRKTLLDKSNKNTYPVALKHSALETIDSYPPTWIHSYTDGSAFKATINAGYGSVINLPSGIKKKKSLTPAGPSAPISLPNNRLSPTQQTTSTTCLTLTHLLPQTSLSLQTAFQH

SEQ ID NO: 2818 - protein, 990 aa, synthetic construct
  source 1..990: note = Description of Artificial Sequence: Synthetic polypeptide
  VARIANT 11: note = Any amino acid
  VARIANT 59: note = Any amino acid
  VARIANT 209: note = Any amino acid
  VARIANT 387: note = Any amino acid
  VARIANT 778: note = Any amino acid
  VARIANT 971: note = Any amino acid
  VARIANT 975: note = Any amino acid
MDHITSINKDXDVKGSSERTASSGRVSHAQQVTPDRHQDTAHKRKNQTRNIATWNVRTXLEKGKLDNIKKEMKRMNVNIMGLCEVRWTGAGRILSDSYNIIYSGGDKHERGVAVIMDMPTSKTLKGYLTISDRVMLVRLKGSPFDTTIIQAYAPTSESTEEEIEKFYDEINQAKTHCKSQDIVIVMGDFNAKVGATRHEDIVGPYGLGXRNERGEKLIEWAILNDMIIGNTWYEQPPRRLWTWKSPGDSARNQIDYIMIKKRYKNGMLNVKTRPGADCYSDHVPVVGKFRIRLKKTHMSKNKNMKLNMALLQSNKEMQDKFRITVQNKFGPLEEIQDIEKQWEQLKTSINEAAKDVIPERTTKAKKKWMTEEILNLMEERRTNKNNXEKYVNLHKEIRHKCNLAKETWLKEECEEMENHSNANSKDLHRKIKEVCHTRTRGSTGCLKSKDGNIIMDKDKILERWTEYIGDLYNDKRDEQRRVENNNEGPPIMKEEVIKALRKMKNGKAAGPDNITTEMIKALEDFGITTLTKLLNNIYATGHIPSDLSKSIFIALPKKPNANECETHRTISLMSHITKILLRIIMMRIRNKILPEIAQEQCGFIEGKGTVNAIYVIRTTIERALEVQKDLHLCFIDYTKAFDKVRHDKIIDMLEVLNIDGKDLRIIKNMYWDQTAAMRIENDISEYIQIKRGVRQGCVLSPDLFSLYSENIMRHIEEMPGISIGGHNINNLRYADDTVLIAEDEEHLQNLLNVIVQESDNMGLSLNIKKTETMVISRXTPIPTCNIKINDTTLKQVQHFKYLGTIISSDGRCHTEIKSRICQAKATFHKMKQILTNINLSLETRKRVLKSYIEPILLYGCEAWTINKQLERTIVATELWFIRRMLRIPWTARKTNEEVLVEANYRKQLITNIRKRQANFFGHTMRKEALENIVTTGKFDGKRGRGRQREKILDKMTTWLGAARTTDTIAAXKDRXKWRSMIAHASRQGTG

SEQ ID NO: 2819 - protein, 1308 aa, synthetic construct
  source 1..1308: note = Description of Artificial Sequence: Synthetic polypeptide
  VARIANT 9: note = Any amino acid
  VARIANT 150: note = Any amino acid
  VARIANT 170: note = Any amino acid
  VARIANT 204: note = Any amino acid
  VARIANT 727: note = Any amino acid
MHTSLHNPXTNKMPLRQMKLYELGCRLGYQGPRSLPSPGGGSDKSATGTHTAGIGATSNTQTLNILQLNISSIQNKKMELAKTLSDLRIHVALLQETQLPKRIELHLTGYTMYHCKCTKCQGIATLIRNDITAEVSHPETDDETDMQEVXVQQSDGTTYTIYNVYCPPRXTLQLNFPNTDHKHTILAGDFNGHSPLWGYSDTDXTGTVLEELLRSSNLISLQNDKTPPTLLHRASGTLSRPDLTLVSADLHPHCSMTVLDDIGSDHRPILLQISSNRKREPTNPIRRSWNYKKANWELYQQKSESRLLDVCTTNPIDECYKDITTALKTSAKEAIPRGNPKKFRPYWDKELEQLTKARKKARRRAEKNPTAENRKHYNYLTAKVKLKTKSAKRQTWREHCGELDLRKDGRKAWNLLTNLSGTKRRKNPAPMKPTEKGETCRAEVMNKYFASINKKGNQNKLSHAIKQLTKRAERTPKANLEVFEKEFTLTELKAALKKCKKRKAPGPDHVTNEMILNLTDSSLSILLGFFNRTWNEGQLPTEWKKANITPILKKDKPASQPSSYRPISLTSCLGKVVERMVNDRLYWWMESTGTISTSQAGFRKGKRTMDHLIRFAQKTSDAFQDKDNVVAVFIDLRQAYDRVWRQGLFYKMQKLGIAGRMYSWIKNFLSCRTIQTSCDSKISSQRTLEEGLPQGSALSCTLFLLFMNDLPDVISCQKALYADDLLXWSKGSDMRALNQAINADLTTISSYCQLWKMEINTDKTVFGLFSLKNKVTASQVNLKINGTTIRHEDYPKYLGVQLDRKLSLKEHLGELTKKATSRLNLLKHLSSLNWGADKATLRQLYIGYVRSVIDYSLPLQSIASQSSLAQLDRVQNQALRFVSGAMKTTPTSACEIHTNIEPLDLRRKSATLETYERFVRLEDTNENRKMADEWEPRTRIQKTSFMREATKLLEEFDPPENREPITNISSEPPYWQTPEITIRTRLLDPSCDKTTPEEILRTSALETVDSYAETPIHAYTDGSATNATRNAGYGSTIKYRNNLGEKKQTQLFGPCGTYSSNYDAERIAIVKTLEQIAQDFFEGAVTPGDVVVFSDSMSVLQAVEGGGDYRGDGNILSLVKQMGTSYGVRVTLQWVPGHSGVPGNETADHLSKTGASLPQTDTTASLQTCRGIIQAKSRDEWLNRWANAETGRSLFGYMDKPNPKDPSNLLCRADQTLIFRARTGHLHTNKHINRINPMWEPHCRHCDYHEETVEHLLLHCPNLAVLRRRLLHTPTDLQSLLYSGVDQMTRTCGYLREALRCQERNARS

SEQ ID NO: 2820 - protein, 994 aa, synthetic construct
  source 1..994: note = Description of Artificial Sequence: Synthetic polypeptide
MKDSGQSRKDSSDPKPSLSNKSLRIASWNVRTLYEAGKSSQVVQEMKRYRLHILGVSETHWIQSGQKQLSSGEQVLYSGREDKYHAEGVGIILSKYAQKSLRGWEPHGERIIMASFTTRSKSINMNIVQIYAPTNDASDEDKDAFYSQLQGVIDKLPRKDVNIIMGDANAKIGQDNVGYERIMGQHGLGQMNENGERFANICAFNSFVIGGSVFPHKRIHKATWVSPDGVTENQIDHFCISRKFRRSLEDVKVQRGADVGSDHHLLLAKLKLRLKKHGTSTGIKRTKFQVSLLDGHKKEEFQLQLRNRFQPLADLGGEDTEVDTHWTKVKEVFTSTCQEVLGGKKWEHKEWISQHSLDLIRIRRQLKAEANASRTRGSRADALEQYRTTAKDVKKSIRKDKEEFMNRLAEKAEEAAVGGHMRILYQTTRTLAGKYGKPEVPVKDQEGKSIFGKEAQSKRWVEHFNSLLNRPPPSNPPNILPARNELPICCDAPSKQEILDAIKKLNKGKAAGPDQIPPEALKADANVTADILLPLFTRIWNESKFPKDWKEGHLVKLPKKGDLSNCSNYRGITLLSIPGKVFNRIVLERIKTGTDPRLRDEQAGFRKNRSTTDQIATLRIIVEQSLEWNSQLIVNFLDYEKAFDSIDRATLWKIMRHHGIPQKLVNLIKSMYEGTSCRVVHDGQLTDSFDIKTGVRQGCLLSPFLFILAIDWLMKETTRGHRNGIQWTPWTQLDDLDFADDLALLSHTQEQMQAKTSVLNSLSESVGLRIHPGKSKVLRTDAQRKEQVTIEGKALENVESFCYLGSIIDREGGTGAEIKSRIGKAQAAFISLDRIWKTREISLRTKLRIFNSNVKSVLLYGCEAWNASQTCIKRIQVFLNRCLRKLLRIRWTDRVTNVEVLRKTRQIPVRDEVGRRRWRWIGHTLRKSGSCITKKVLDWNPQGKRSRGRPRGTWRRITEIDVQKSGKTWNNIKRLAQDREKWGVFVRGLYPGAG

SEQ ID NO: 2821 - protein, 1114 aa, synthetic construct
  source 1..1114: note = Description of Artificial Sequence: Synthetic polypeptide
  VARIANT 1041: note = Any amino acid
  VARIANT 1047: note = Any amino acid
MSPRVTFDDGSDYSVALISYRPSQTGQPPVSKVLIRHVCLLLWVYGARTKTERQTLNPAPGKKRVKLTPWKLGTWNVRTMTTGLDTTNLEKTEDIRKTAIIDRELTRLNVDITALQETRLANSGTIRERNYTFFWKGLGEDERRIHGVGFAVHNRLLNRISTPQGISERITVMEMETKTGKAHFISAYAPTLTTENEKKDQFYEELQDAINNVPKADQLFLMGDFNARVGTENKVWPTCLGPFGLGKINENGQRLLEFCTNNNLCITNTFYSGKDRHKVSWCHPRSGHWHQIDFIIVRKKDANMVKQTRSFYSADCNTDHLLVIAKAKIVTKKTPRAEKQKKPKINIRNTKDPALKAKFQEHVKEELQHLDSSSPDNMWNSMRSTIYNSASITFGIERPCKEDWVEASASTLAPLLEKKRKILIEHNTNPTESTKQQLRAAKSNLQRETRKCANQYWDKLCSEIQQASDTGNIRKMYENIRVAIGPTANKVAPLKSATGEQLTDKKKQMERWVEHYSDLYSEERHVDRQLHEAIPQLSEMSELDTTPTEEELSSAIDELACRKAAGNDNIPAEVLKENKETLLPYLYKLLTTCWLKAEIPHDMRDAKITTLYKNKGDKGDCNNYRGISLLSITGKAFARIILKRLQKLAERVLPESQCGFRSNRSTMDMIFSIRQLQEKCREQRLPLHTAFVDLTKAFDTVSRSGLYMVLGKIGCPPILLQLIISFHEDMKATIQFDEGCVLAPTLFSTYFAVLLQHAFKESPGDVFLHWRTDGSLFNLARLKAKTKINKTTVRDLLFADDAALVAHSESTLQTMMDRLSTACKVFSLVISVKKTVILTQEGAEQSHIWLNDKELETVDKFCYLGSTISSTTSLDYEINIRIGKAATTFGRLTKRAWENKRLTIKTKIKIYEACVLSTLLYGSETWTLYSRQEKRLDIFHLRCCRKILGISWRDKVTNVEVLARANLQSMTTILCLKRLRWLGHVKRMDDNRIPKQLLYGELAQGKRQRGRPKLRYKDTCKNSLSKLGVDVSIWEEIAEDXKTWRKXIKERTKMLENSLRNNQAEKRQRRKENSGNTELRSTTLTCKHCDRICASNIGRISHERSCMKTTLRPS

SEQ ID NO: 2822 - protein, 827 aa, synthetic construct
  source 1..827: note = Description of Artificial Sequence: Synthetic polypeptide
MGDFNGRVGERRTPWTKHLGPHSDHRTPCNYNGNHVLELCAEHDLFITNTFFQHRASQIYTWYRWNNIMVSSQIDFILTRTRMRITITDSRAIPNAGLDTDHRPIITTLTTKKERKPKKHKRQQERLNMHKLGDDQVQAQIRSTLNEKLGSINSTILTVEEAWDTFKTTLLDTMKEVCGTKKTRGKHRKATAWWNEEVKDAIKEKKRLYNVWVKSKNEEDYIKYRLARRHSKKVVITSKEKSWTQYGEKLSETCKTSPREFYKKVKTMRTRDEPYVPTTVINDTNGEALHEEKEIIKRWEEYFQELLNPSGVQAQNTQCPFTANYPEHSEPTILESEVREALKTSPKNKAAGDDGITTEAILACGETGIHWLTIIFQKAWKERKVPADWQNAIVVPIWKKKGSKKDCNTYRGISLLSHAGKMYAKILERRTRAKTEHLLSDAQFGFRKGRGCTDAIFALRQLCERALEYDKDLHLVFVDQEKAFDRVNRNKLWKILEQYDIKGQLLDNIRAIYANSRSAVRTTSGTSDWFPVTSGVRQGCNLSPLLFVIYMDQITKEANPDPEALNELMFADDLAMINNKTQLQEHINQLNASCEKYDMKISISKTEVMTISRRPGKVDININGSQLKQSREFKYLGSIFTENGKLDREIETRCQRANAVSYQLGPLLKHPNIPMSTKAKLINAIFLPTLTYQCQTWTLTKALERKLVTCEMKCLRRAVNKTRRDKIKNEVIRDTVGATPVLPHIEKQKVKWFGHLTRMPSNHPALRAYNIKYSGWRARGRPRRRWSESVADTLKDHGMSLLQATRLAADRHLCLPATPQGTSGRKK

SEQ ID NO: 2823 - protein, 945 aa, synthetic construct
  source 1..945: note = Description of Artificial Sequence: Synthetic polypeptide
  VARIANT 763: note = Any amino acid
MLGAHDLNLILPKGTITWKSRGSQSTLDLAFVSNALESTVMACKPAFDLEASSDHIPICTQLHIEPPNREEQQPRPQWKKADWEEVNRRLALKLSRLSTDHLELNSPESIDQRVSAITQAIKETIPTARPSTFAKPYWTKECSETVKEARKARRLWTKLGSEESWVEYQKATNRKKSQIKKAKMIGWRAIVSEATNDPAKLWKLAKWAKKSPEERSRLPQLPDIKDKDGNMFTEDTEKADILAQHFFPQPVQANLEDIDGTRYPEELTTVSSIITASEIQDTMANLASEKAAGPDGISNWMLKNCRITLGKVLEKLFNACISIGYHPKGFKESVTIVLRKPQKESYDNPKAYRPIALLNTLGKVLEKLVANRLSKAAEAHHLLPDEQMGARQLRSTISAVELITEQVHSIWGKNKRRVASLLSLDISGAFDNVSHKRLIHNMRAKGIPRWTTQYIESFLEHRTTSMNLGSFKGEQFPTSTGIPQGSSLSPILFLFFVSTLLPELQSPSSTAVGFVDDTNILTWSNSTEDNCRNLERLHGICEKWADRHGVKFAPEKYQLMHFSRARKRHNMQATVQIQGHLAKPQPSLRVLGIHLDPKLNWGAHVKSIQLKVEPQIQALGRLAQSTWGATFHKAKLVYNAVVRPAVTYGSPIWAEPGMAGKIPERVIKPLRSIQRRCLKIVTGAYNSTSSKVLEHETSTLPMEIYLKQRRVQHAGLSKSLPVQDTISSACRKIKQPRAGRQDARAVTRIMDIADWGKIGANIXTKERQKAAGKIAAFKEWERSWTRLAARQPTNHHATADPKIWNAANIFTDDKTGRTRMDQRGTPSSLHKHLSRAQSSIAMQIRSEHIGFNSYLHRRKVPGVDSPRCQCGYPSQNVKHMVMACTSWAKGRGEILRKAENRSFEAMMNNPKDLARITRWIQQEGRLEQFRLTLEVEATMRAREEG

SEQ ID NO: 2824 - protein, 337 aa, synthetic construct
  source 1..337: note = Description of Artificial Sequence: Synthetic polypeptide
  VARIANT 85: note = Ile or Leu
LLQKLINFGIPSSFVSWFAVFLADRTFSVKINDSIGDTSPTIPSGVPQGSVSGPLLFLIFINDLLLSLATIPLLHIAAFADDIKXFSNDPFVVQTGIDTVVGWAKSNSLPLAHSKTALLHLGSLNPFFPYTIAGNPIIPTSSVRDLGLLTEPNLKFSAHINRTVALALLRSKQLLKSFKSSSPQFYVYLFKCYVLPLIEYCSVVYCPPSTSKLSLKLEYPLRFFTKKVFHRCNISYTSYPDRLAHLDLFSLRHRRLKAQLQLLYNFLSGSSYFPNLDSHVRFSSSPRRPMNLVNVNPRVKDFFFITVPIWNAITCHCPTFLRPSEFNSLLQCSIQRF

SEQ ID NO: 2825 - protein, 1023 aa, synthetic construct
  source 1..1023: note = Description of Artificial Sequence: Synthetic polypeptide
IGLAGHYRVSRDTTFALNSNPSCLSPPHPASAKGKTVPGARRKRRSNLGVQTICQSDLEIKKPRDKTRRTDYRVCTFNCRSLSSDDRLAELLEETRRIQFDVIGLCETKRAAEAHLIHHDGTGVFLGKRNESSVSGGVGFIVRSTLLPKIVEVRFLSHRIGLLTFKVSRKFNCTVIQVYAPTADSDLEEICDFYDSVEDVFRECRSKYKLVIGDFNARMGCRQNNERYIGPHAMEPRNDTGELLATFCETNRLWHTNSMFKKPMHKRWTFVSPDGNHRHEIDHILANGKFVTDTTVLPSFTNGSDHRLLRCNLHFNNCLAKLEQVRRRKPPKRVLDPAIAYAISATVTVQSDPDLDTDYDNLIQSLKELQDQAIVRPANHSSNRLSEETRKLLNKRRFMDRNDPQFKSISDKCREAVQKDHEAFASTRLLSAANQKKSLKRVARDINEYKSVIPCLKSTSTGERITSRVKMEQEIEKFYTELFKSAVSNSQTSSIPATATPPPFLPEEIRHVLRSFPNGKAAGQDKISADFLKSCHDNVIDLITDRFNRYLHSRNVPKPWKTSKTTLIFKKGDRENLENYRPICLLPVLYKVFTKCLLNRMRRSLDEAQPVEQAGFRRSFSTIDHIHSLQRLLEVGREYQIPLTLVFIDFKKAFDSVEHQAIWKSLDEQGADGAYIDLLKECYKNCTTNFTPFHRPVAVPVTKGVRQGDPISPNLFSACLEHVFRKLSWIELKGEAEDYDTIPGMRVNGRNLTNLRFADDIVLIANHPNIASKMLQELVQKCSEVGLEINTGKTKVLRNRFADPSKVYFGSPSPTTQLDDVDEYIYLGRQINAQNNLMPEIHRRRRAAWAAFNGIKNTTDSITDKKIRANLFDSIVLPALTYGSEAWTFTKALSERVRITHASLERRLVGITLTQQRERDLHREDIRTMSLVRDPLNFVKKRKLGWAGHVARRKDGRWTTLMTEWRPYGWKRPVGRPPMRWTDSLRKEITTRDADGEVITPWSTIAKDRKQWLAVIRRNTTNS

SEQ ID NO: 2826 - protein, 473 aa, synthetic construct
  source 1..473: note = Description of Artificial Sequence: Synthetic polypeptide
NMKQPAKRTVMTCLDQRAAFDKVPIKKLCVDLHESLNEAKISKWLTNYLSKRIIKANFGNHSSKWCTLLGGVPQGSVLSPNLFSFYMRNMPIHPKTEITVYADDTTILAQDTNPFKAGELIQEHLDLLYDFFNERKMSISAEKSTTTLFTCDTKEFKTKIPVNWNGAEIPTTNQVRLLGVHLNTMCGSKDHVAETRKKMMVSTNILKALSGTKWGCSKELLISTAKALVKPIAIYGAPAWSQLLSETNLNKLEAAYRNTLRTCCGLTSDTPIEHIYAEAQMMPLKEEFELAKQQTYIATTKSGTHPNRNLESRRNTERRSNRPREPPLNLQEATKTHLSRLKGTKAEAQKANHTRFVREFLNSAPPNRILGATPPPLNSSEESSLPKATRTELARLRCGHSLLIPRYKARIEGTPIGTCGCGDNEGGIDHYLSCGRSHPISKEKLWTSPMEAARALGLAYKPYDPGGGATTSV

SEQ ID NO: 2827 - protein, 726 aa, synthetic construct
  source 1..726: note = Description of Artificial Sequence: Synthetic polypeptide
MPTRKSKILDVALSNSVISNLNIMAPIGSSDHNTIKFTVQLLQNISVPKKMIPDFSKLDWPCCATYFENIEWGKVFDTHSHVNDIYECFLGHIRTMFSQAVPTMPMPETSKPVPQYLRSFEQMVKNQFSKTIMSKTMNDFIEYIYLARKYRKKLRKYLSNLEVKLFKKKGNSKFSKHAKTLLKPRNCSVPALIDNDENEIVSELDKANLLASYFEAQYTNQNNTNFALDDDFVSDQPIPWVTDAEVLKVIMASKKSCSVTSDQVPFTFIKILSPLISSVLAQIFNLSMMRGQVPHAWTESIVIPLDKITNANNPTDFRPISLTSHLCRVYERCILAKIELFLIDNKFWSQNQHGFRPKKSTVTNMLESLNDWSKSIDLGEQIDIIYLDFSKAFDRLPHDLLLDKLVSLRMNKNLLIWLNEFLSNRSFRVRIGQTLSSRKLATCGVPQGAVLSPLLFGIYVNDISSILPEKVACKQFADDTKLYVSTPKTESENNLQSALDAVVDWTRGSKLTLNQSETVHVTVGKRRTDFKYHLDGYPIERKAITRDLGFLISEKLDFSEHWRKCINLAKFQLANMFNQYSTSNKKLMILLYKTFIRPRLEYGTVVSSPTKKSDEKAIESVQNAFTRRLYSRIKKRYINPTDKDYKTAMERNELFDLQTLSTRRKIIDRIQVIRMNNGKVDLKTSEFFEQQETHTRSKKKYIWSTGKSKLRRHFFVNRTLATMKQH

SEQ ID NO: 2828 - protein, 605 aa, synthetic construct
  source 1..605: note = Description of Artificial Sequence: Synthetic polypeptide
  VARIANT 7: note = Any amino acid
  VARIANT 8: note = Any amino acid
  VARIANT 9: note = Any amino acid
  VARIANT 12: note = Ile or Leu
  VARIANT 13: note = Any amino acid
  VARIANT 17: note = Any amino acid
  VARIANT 35: note = Any amino acid
  VARIANT 37: note = Any amino acid
  VARIANT 38: note = Any amino acid
  VARIANT 42: note = Any amino acid
  VARIANT 43: note = Any amino acid
  VARIANT 44: note = Any amino acid
  VARIANT 47: note = Any amino acid
  VARIANT 48: note = Any amino acid
  VARIANT 49: note = Any amino acid
  VARIANT 50: note = Any amino acid
  VARIANT 143: note = Any amino acid
STKLDLXXXEDXXFNEXHLNKSSPKAFFNFINSRXKXXQEIXXXRDXXXXQVTSDYMKAELLSNCFSNAFTEDKNTNTDFPYRTNHFINSLCFEPFIVESILSKLTPKCNTTPDGIPAIFLKRTCTSIALPLSIIFRNSYNQXVLPSFWKTALVKPLHKKGSRSDPNNYRPISLTSAVGKVMEKMVRKSIILFLDDFKLLSNSQYGFRSKMGTESQLLSYQNKLVTNYLSKQTTFSVYIDFRKAFDTVGTKKLLIKLERYGIRNHLLRWLENFLSNRTQRVIINGVMSEEKSVLSGVPQGSVLGPLLFLLFVNDIGDNFNSDYLLYADDLKIFSTDKSSIQRDLDSLSTWCENWQMSVAPNKCETIAFYHSKRGMDKDTKFTIGGATVPITSRIRDLGMFFTSDLSFSNHIDTVLRKAHQRVNIFFNVLRHAGFDTFIKCFIIYVRPLIEYGSIIFSPTLKDLVKSVESVQKSFLYRCFKKFRIEYISYFDSLSYCKLESLEHRRLIIDLTFLYKLIVSKEIFIHNFTCITRSPLPSLRRHPYIVRSTLRNSSKLSHQFFSNRIITCWNSLPSYLFPKLICSETFKSALKCLDLSKFLTLNMHNY

SEQ ID NO: 2829 - protein, 960 aa, synthetic construct
  source 1..960: note = Description of Artificial Sequence: Synthetic polypeptide
MFGRSTTDTEITEASYGPKNRRKGNDFHIGSLNVRSISDQSKAEAFDLLAVNSGCKVIALQETKRKEGEWVLSSGAELICTRREAREGGLAFWIHKDWLDSLVETKRESDRISTASFDFHGSHLHVINVYAPTSAANETQSDKFYKDLKKVYTRLSKWDSSIIICGDFNAVVGCSSDDLPFVGGHGTGQRSDNGDRLVNFAFSSRVSILNTIYPKRPNRKWTWISPNGKTKNEIDFILTNRREIAVDCEVYCDYLNCSDHRLLRARFRSTAKKEKSRKFAKTKRAGGERSWDPVRFKNTITEMLTENPPTCYEELTESIRSAASTATHATHQLSRISEATKKMMLSRFQMIHAGQTKNADLAKINNEVRRSLENDLDKWREVKSLEAAVKGRSLKKTKRALTLKSSPFTNLERPDGSTTYNRPEIRKLVLTHFSNLYAATTREPRSRYNHPDEPEILQHEVEHAIVTSKTNISPGPDQITMLQLKLGIESIAPHLTAALNQVLTNGRTPEDWKTVKISLLPKTTKPKKVKDYRPVALSSIVSKLFTKILTRRITAKSEDYLEESQAGFRRGRGCADNIQVVAQMWEKCTEFKIPLVAVFLDFTCAFDNVNWTKISEVLNNLQIGRNVIRALNNSNSSAIGELNVLNKKMRFKIKRGVRQGDSSSPLLFALALQAILDELDPAPCEDDKTGIDINGESIHRLEFADDVVLFANSVKEAEDRANRIAMGCPKYGLNINPSKTQILMNKYVTRSDIDILNTRIEISQKVKYLGRTFADDGSLTEEVARRIRAGWAAFNAIRRELLQSPQKIRIRLLTTTVIPAMTYGCETWTSKEADTKRLQRAVSNMFEIAGCDPPDMEKQVLRRKLKWAGHVSRMKYDRWAKIASEWDPRGSARPRGRPPKRWADDITDSIKIFIHNEALRGNLGHGRRRIGILEARRAWSTVGRDRVTWRSLVRSIQDGN

SEQ ID NO: 2830 - protein, 959 aa, synthetic construct
  source 1..959: note = Description of Artificial Sequence: Synthetic polypeptide
  VARIANT 38: note = Any amino acid
  VARIANT 43: note = Any amino acid
  VARIANT 57: note = Any amino acid
  VARIANT 128: note = Any amino acid
  VARIANT 150: note = Any amino acid
  VARIANT 187: note = Ile or Leu
  VARIANT 367: note = Any amino acid
  VARIANT 520: note = Any amino acid
  VARIANT 655: note = Any amino acid
MPTNHSQRTLMPRRCKYERTRQRIFSRIQKTNFAQHRXFNFFXHSPDLILSILSANXRSLMANKLEFQYIVNTTSPDILCIQETWLSSKFGNASFLDPNSNYHVFRADRCATSRGGGVCTLVKKEFPXTIITAETKNSAYELITVDIDVXVTPLRIINIYRPPSCSFENTITLLNKVSDLSNHVGQXVILGDMNINGINWNSAVPTSQTRLGSLLCDFCNQNNLTQYIRKATRKENLLDVVFSNSRLSDVRILSPIGSSDHNSINFKLDILQRPPEKKILFYDYKNIKWPKCLDYLGSIDWGRLLHPGNSISTMYQNFIDHMREAFELSVPKIYVEPTIRNTPDYLKSFYKLVQLKLERVKASRGRXDFLDYIKTAKKFRKKLLKFRRNEEVKLLESSGVSRFSKKAKYLLKPKSLRIPTLTNPLGVLSVTNAEKAEILADSFESQYVNRPLLNFELPSNFKSPQEIPWVTDAEMLSMMLKCKNSCSQTPDNVPYKFLKLIAHLISSPLAQLCNLSMMRXECPSLWKESIVIPLNKKEKPMAPTDFRPISLTSQLCRIYERCLLKKILQHLDTIKFWNNDQHGFRPKKSTVTCMLEAVNDWTESIDEGAQVDVIYLDYAKAFDRVPHDILLGKLVDANLNPNLIKWIRSYLSNRXFSVKVNNESSTPKHAQCGVPQGAVLSPILFGIFVNEIPSILPSGIRCKQFADDIKIYTAIPKSDTIEDHETLMQSAIDAVCNWSENSKLALNDSKTLVISLGKNPRTTKYQINNNPIRRETSIRDLGFIITPMLDFTGHWKKAICKAKFSVFQIFNHYCSNNPRLMTLLYKIFIRPILEYGTEISNPTRKLDCKAVESVQNAFTRRLYSRIKGRYLTPNDPDYLTAPQRNSLFNLSSLESRRQTSDRKLILKMISGLVDIDTSPFFTYEKNTRTRAKNKFKWNHCKTKIRRNFFVNRTLSSFKL

SEQ ID NO: 2831 - protein, 648 aa, synthetic construct
  source 1..648: note = Description of Artificial Sequence: Synthetic polypeptide
  VARIANT 21: note = Any amino acid
  VARIANT 117: note = Any amino acid
LINILNELLTELCPRIPERPXSKVCPLLRKLRRLRRYKSSSLSHADIANRLKRYRALASRYRKWVLKHETKLINESNCTSIRKFVSKRLKSKQSIPALLDNGKAVTSDFVKCDLFSXSFMKNFACPPEEYSTPTPSHYGSDSLSSFSSPSSSRCLFLPYIVEKVLQHLPPKCGFSPHLANYLVLKKCATPLALPLSIIFSQSYCESEVPAAWKLAVVIPVHKKGNPACTDNYRPISLTDPIARVMERVICNYIRSELAYKFSPYQHGFLHFRSCTTALASSTAKYRQILKKSKTLDIIFFDFSKAFDQVSHSILLDKLAKFGVDPLTCSWFENFLCDRSFTLKVNNTFGDKLYPVYSGVPQGSVSGPLLFIIFINDLLFSLPPPIHYSCFADDIKIFSDSPEILQSGIDTVVQWSIRNCLPLAPTKTSLLHLGDKNRMLKYFIHGIEIQHSSCVRDLGLITDSSLTFKIHISRIAALANLRANQLLKCFSSQSPQFYAHLFNTYVRPLLEYCSIVYSPSPSSSLAGKLENPLRTYSRRVLQRCNISFSSYENRLEILNLTSTRHNRLKSQLLFLYRIVTNNSHFPNLSDFVSFVKSNRRPMLLVRNDTCTLHFFARTVPIWNSLLRNCSTFLSPIEFSNLLNVNISRF

SEQ ID NO: 2832 - protein, 779 aa, synthetic construct
  source 1..779: note = Description of Artificial Sequence: Synthetic polypeptide
  VARIANT 3: note = Any amino acid
  VARIANT 33: note = Any amino acid
IFXTIILLYWAISIFPQSTGDLLPDSPEFLVDXMTSFHLSQLVTFPTRTSRLGKKNFLDLLFSSNTSIIKNLKAGSPFILSDHCSVLFSLSLATSTIPKPPTEDPQHLHFRKCDFNKLNCHLFSYNWPKQLSYFATADSKLYHFLKIFNELIEQYTPISTKRTVHSKITGKKLYRKLRKRHPNSLSLSLKKRVKSRLKNIRKSFESQEKKVIASKNPRSLYSFIKSRIKTKSTLTHFEVDKKVIQKPSDMADLLVNIFSKNFNTPPPPFPALPSPKPLNTSIDTSPFGIYQVIAKIKPKIGYSKDNINNFIIKNCADSISIPLSLIFGEFLLSRTFPDCWKISTVIPVFKKGNIHDPLNYRPIALTHPLARLFEKVVIGPIRRTFSPKLSKKQFGFLNNRSCTLAHLHASSIFHSVLSYPKSYLDVILIDFRKAFDSVPHELLLCKLSNFGFDTKLCEWFREFLTGRSSIVKIDNNYSSIKFKNSSGVLQGTVTGPFLFLVYINDLLESFPDDVHVVAFADDIKIFGNNRSSLQKSIKIIEEWCSIWQLKLAENKTQVLHLGVHNPRVEYHIGGITIDKCTSVRDLGIWVDEKLQFRKHINIIVNSCMYKVRQILNSFRSSNLNFYFKLFNTYIRPVLEYGCEVFNPCSVSMSTSLEKPLRFFSRAVFKRCRVNYLSYADRLLQANQQTLKHRRVLLILKTYHNIISGWYHFPNISQYIKLAHTPRFPYLLQPRGKWTPNNFLHKYLSLWNKIAKKFPKTVSGATFHLHISALPLDSYL

SEQ ID NO: 2833 - protein, 1048 aa, synthetic construct
  source 1..1048: note = Description of Artificial Sequence: Synthetic polypeptide
  VARIANT 245: note = Any amino acid
  VARIANT 351: note = Any amino acid
RPAPPPPSQHTTKCRAKPAKTRILSWNVNGWSKRRSELATIIAKEKPDIVCLQETKLDKTNLGYTPTGYKVALASRNKFGGGVCTMVRDDWIFTISKTTSKKTAEILSITIDKLMVTNVYFPPRSSDSPTAEVREDVMEILDMASEKHIITGDWNAHAKTWHSHKTDERGAMIEDELDTRGVHVVLNEDSFTRAASGVLSSPDITISTSDLAACSSWRTCGVLNTDHLPVIIDTMAEIPKLVRPXRIMANFKKANWTDFSDSIETKVACYAGPRDAYSLENFLSATITRAASKHIPHGKFTPTREHTGDTGEIAELTRERERIQKRNPLDSNLKALNDKIEAARRELRRLXWHQKIEDMEDKRKIDCNALWRVIKGLKPKTKSTGSIRLPNGTTTTNPKTIANAMASSLVAVGKGRDCREERIAWRRTKRRLKKLRPQLPASSISHAEVKLAILKGKPSKALGPDGICHLHLKHVPDNCINLMAELFNASIDENKVPDSWKKANVFMLPKPGKDPSEIKSFRPVSLLSPVAKVLERIILERIRREIESPKDQHAFKKNHSTTTAITEATSCIVGGLNMEKPACRTIMTCLDMKAAFDTISIAKLLCGLEDAIADKKVCGWLGNYLHKRRINVQYDDVKSSWLTLRGGVPQGAVLSPNLFNFFIRDVPAIPDTKIITYADDMTLLVQDPLLSKAAEKSQDALDSLQKWFKDKHLDISAGKSTVTIFTADTKEFKYDPGLKWEGSVIPMQNRTRLLGVELDTMLRMTGHVEQVSARLAKANNILRALAGAKWGSSKETMLRTFKAIIKPLATYAGPAWHQLMSETQKTKLERQYVGGLKACCGLTKDTPRQLVYHETRMLPLSEELTLGSEQLAIAAIKTPGHPTSDLSRRRPKERTCGNRPRTPPLGCLEDRGDEWRRMRGDTRAVQKRNHTSFVKSYLSNHGIHPILGRQPPALSEEESTLPRNTRVELARLRAERSLLLEKYKAKVENRPVVCCIKCNDDVGDLKHFLKCYPVKPLPMSKLWKDPVAAATALGLAVTPFDPGGDADS

SEQ ID NO: 2834 - protein, 832 aa, synthetic construct
  source 1..832: note = Description of Artificial Sequence: Synthetic polypeptide
  VARIANT 35: note = Any amino acid
  VARIANT 71: note = Any amino acid
  VARIANT 643: note = Any amino acid
MPPGNEDRYRTRGIHSNWLQDRYGPEEQARRRSVXNGQARLGLHDHSIHDEESGLLITNVYFPPRSSDSPXAEVREEVLQILDMEDRKHILTGDWNAHSSAWHSHKTDERGSMIEDELDSRGNHVILNENTFTRAATGILSSPDITMATADIASRATWHTCGVVNTDHLPIIIAMDSEIPKREKPKRVIANYRKADWKGFKTDVETRIRSYVGPRDAYSLEKLISKAILEAAGKHIPSGRFVPTRECQGDTKEMDDLLKKRDEIQKLNPLDGKIAEINDVIEKSRRELRKERWLNKVEDMEIKRKTDSNCLWSLLKGLKPKARSSGPVNLPNGTTTTNAKAIANAMAKNLVTVGEGRENKDEKMAWRRAKRNLVKSKTTLATTITHAEVKLAITNGKSSRAMGPDGLCHIHLKNLPENGIHALAELFNATISENKIPDSWKKANVFMLPKPGKDLTEIKSYRPVSLLSPVAKVLERVILERIKPEIQSPTSQHAFKKAHSTTTAIIEVTNRIVGGLNMPKPANRTIMTCLDLKAAFDTVSIARLLCELDGAIQDKAITRWLGNYLYKRKIRTQFGEEKSKWRTLRGGVPQGAVLSPALFNFYIREVPTIPGAEIIGYADDTTILVQDPILQKAADTSQNALDXMKTWFDERHLDISAGKSSVTIFTADTKEFNFDPGLTWDGTPIPMQNRTRLLGVEFDTMMKMNGQVAKVSERLAKSNNILRALSGASWGSSKETMLKTFKAIIKPLATYAGPAWHQLMSDTQMAKLERQYIGGLKACCGLTKDTPKELVYYETKMMPLKEELELGSEQFAISAMRTPGHPAKDLHTRRPA

SEQ ID NO: 2835 - protein, 909 aa, synthetic construct
  source 1..909: note = Description of Artificial Sequence: Synthetic polypeptide
  VARIANT 287: note = Any amino acid
  VARIANT 427: note = Any amino acid
MMHRDGTGVFLGKRNTTSVSGGVGFIVNSTLLPKIQEIKFLNHRIAYLTFQVDRRLSCTVFQVYAPVADSDPEELADFYESLEEAYTACRSRYKLVVGDFNARIGPRQHTERFIGPHSMEPRNESGELLATLCESNRLWHMNSQFGKPSHRRWTHISPNKLHKHEIDHILANGKFVTDVSVVPSITTGSDHRLLRGNLHFNTKIARFEQVKRRKPPKRVLDPAVAHAITATATITPSADIDLDYINLIAMLKELQDQAVTQPSNHSTNRLSGTTRQLLTKRRFMDRXDPNFKSLSNECREAVKKDHEEFAKDRLLQAAQNKKSMKKVARDIQEYKTFIPCLKSSTSGTRITSRTEMEKEIQQFYSKLFRSNRGPPVIASPIGMEIPPPFLPEEVRAAFRSFPNGKAAGDDKITADFLKSCHDNVILXLTDRFTKYLQSGKVPEKWKTSNTTLIFKKGDKEDLENYRPICLLPVLYKAFTKCVLNRIRTTLEEAQPVEQAGFRRSFSTIDHIHSIQRILEVGREYQQPLTLVFIDFHKAFDSVEPQAIWESLKSQGVQPAYIALLQQCYTNCTTTITPFHKKIEIPITRGVRQGDPISPNLFSACLESVFNKMSWQHLRGDEDDENDKANLLPGIRINGQNLTHLRFADDIVLVASNPKAASLMIQELVEMCGKVGLRMNTNKTKVMRNKFASQSPVNVTLNNVTTCIEEVNEYVYLGRLLNHNNELEPELHRRRRAAWAAFNNIKNTTDALSCPRIRAQLFDSIVLPALTYGSEVWTFTQALSERVRVTHAALERRLVGISLSEQRQRNLHREDIRAQSEVRDPLLVIKKKKLGWAGHIMRRNDGRWTRLVQEWYPIGEKRPVGRPRMRWSDSLKEQISLFDGNHLKTHWSTIAKDRMAWKAVIRDHIR

SEQ ID NO: 2836 - protein, 898 aa, synthetic construct
  source 1..898: note = Description of Artificial Sequence: Synthetic polypeptide
  VARIANT 124: note = Any amino acid
  VARIANT 171: note = Any amino acid
  VARIANT 195: note = Any amino acid
VLVNRHEIQFLIDRAKPDILCLQETWLSEKTPSPTLVNPPSRYQIFRTDRAHEKRGGGVCTIVKSEIPAKVITSETKNMAYEILALDINISTTPIRLINVYRPPTCSYANTLTLLTKISDMTNXNGQIIILGDFNIKNIKWIPAGPMTKDRLGTILSDFCKNNNLKQFVNXPTRKNNILGIVFSNTKLENVEISXPIGSSDHRKITFTLDILEKPTKHLIEIWDFKGINWKVCAAELNLIDWPTIIDPVKTISEIYNEFLTIMRRICELAVPKKRINKELYNVPEYLVTFHKTIENKFDKLLKSRSWADYALYIELSRKFRKKLLKFRRNQELLTLKKSGNSHFTHIAKNILKPKFSMVPTFVDQSGHHATSDHEKAEVLAVNFESQYVNKSNTSFTLPPDYKSDQEIPWVTDAEMLKFIQKCKNSCSDTPDKVPFKFLKLIAPFIASPLSQICNLSMMRGEVPEKWQQSIITPINKIAKPQVPTDFRPISITSQICRIYERCILSKLLPFLDKIRFWNNNQHGFRPKRSTVSCMLESLNDWTNSIERGSQVDVIYFDYAKAFDRVPHDLLLDKLVSIKLNGNLLKWLASYLSNRTFTVKVTKNQSSTKMAQCGVPQGAVLSPILFGIYVNEIPSKLPMGVHCKQFADDIKLYSEIPKDSDPQNNKLQQAIDAICQWSETKKLALNNSKTILISLGKTTKNCDYVINGSPIGRKQLTRDLGFMISPKLDFSEHWHKATNQAKYALSLIFKKYCSDNSRLLTLLYKIFIRPILEYGTVISNPHKKSDIKSVESVQNAFTRRLYSRQKGRYIRADDPEYLSAPERNSLYGLSSLENRRKYFDRKFLTKMIAGNVDIDTRPFFTFFQNTRTRAKTKFIWARSKTKIRQEFFTNRTLTAITL

SEQ ID NO: 2837 - protein, 588 aa, synthetic construct
  source 1..588: note = Description of Artificial Sequence: Synthetic polypeptide
  VARIANT 34: note = Any amino acid
KILVSGSSKNFFKFINQRMKESSDVGMIMDGKTXVYDNYRKAELFAESFGKVYSTDDGQYTTCDLRTSAHLSEIIFEPYAVELELSKLASKVNTSPDEIPAIFLKKICTSIALPLSIIFNTSMRTGFLPDLWKTAIVKPLFKKGSRSDANNYRPISLTSTICKTMERMIRKEMMKHIYGNKLLSNAQYGFRPHRGTEAQLLHYISCIQSNMEKKKDMSSVYVDFRKAFDTVSLPKLQIKMESYGICGRLLNWLSSFLTDRHQSVVLNEVFSPRMVVKSGVPQGSVLGPVLFLLYVNDIGDSLECDTLLYADDLKIFSTDSAALQRDLDRISNWCRTWQMDVAPNKCEFITFNYSKKNSALSFPLMIGNFNLQRTTEIRDLGVIFSNNLSFKSHISVIVRKAHQRINILFNIIRLSTIDVFIKCYVIYVRPILEYGSVVFSPISKELVKTIESLQKSFIYRCYKKFGIVYNSYFEALEQNNLETLERRRLMADLVFIYKWLVSREINIGHDLFISSANLLPLRRHNYYIRCQLTGATRIGSQFLSNRIIRCWNSLPVKTFPVKFSSTAFKNRLQNLSLNNFLLLHFHNF

SEQ ID NO: 2838 - protein, 434 aa, synthetic construct
  source 1..434: note = Description of Artificial Sequence: Synthetic polypeptide
  VARIANT 16: note = Any amino acid
VIPIPKKGSLSSPENXRPISLTDPFARLFERVICEYIKLHFAHKFSQNQHGFLAYRSCTSSLVHSISCYKSSLSSNNSLDVIFFDFKKAFDKVNHKLLLQKLALFGIPHLFIEWFSNFLSGRTFSIKIEDFTDTSITQIPSGVPQGSVSGPLLFLIFINDLLLDLALIPSLQVSAFADDIKIYSSNPVAVQKGIDLIETWASSNSLPLAHTKTSLLRLGSKNISFPYFIAGQPIETSKSVRDLGLITDSTLKFKSHINKTIASALLRTKQLLKSFKSTSPQFYIFLFNCYVLPIIEYCSVVYSPPPASKLSLSLETPLRFFTRKIFQRCNITYSSYSDRLAQLNLFSLRHRRLKAQLLLLYKFLSGTSYFPHLDSYIRFSSSTRRPMNLICIKPKCSDFFSHTIPIWNAITSQSSYFLSPSEFNTLISSSITRY

SEQ ID NO: 2839 - protein, 940 aa, synthetic construct
  source 1..940: note = Description of Artificial Sequence: Synthetic polypeptide
VQKGPNSLAVDNSTKQVKFLSVGYANCFSVKNKLAQLELVTITNNFDIVCLTETKLDNTFPDSLLSLSNNFSVVRKDRNKHGGGVAILISKSIRFLPIEIPSSLLSSEIAGVDIMAGGVSIRIVVGYHPSHHSKLDGMISCLEFLLSTRKNCVILGDFNMPHISWPSLTASDSHCKKFLSFVTKNGLTQHIASPTRLKPDNILDLCFTNTDILRDVRVGDLFSDHKLIHVTLSVKNRTKKLTKEVKLFRKADYASINYLLSNTDWVLRFSNLNADGMYENLLSILHELIASYVPVKAINTLSKRHSAEILKLQKAKLNVWRKEGNSTNYKNISADLKVALIKEERRVNDEKLTNGSVKDFFKFINSRYKDNQEIGTLKNDSGAPINCDSEKVELFSDSFSKVFTEDNNVQPHFDKRTEELVSSPDFEPYIIEHTLSKLTPKLNTTPDGIPALFLKNVCTAIALPLSIIFRESFRTSIVPTAWKTAIVKPLHKKGSRANPNNYRPISLTSSVGKVMEKLVRKQLTNYLNSNRLLSNCQYGFRSSMSTEAQLLSYQADILTNYICKKTTHSVYIDFKKAFDKVSLSKLKIKLRSYGIHDDFFNWLCAFLTNRTQRVCINNVFSSDRSVLSGVPQGSVLGPLLFLLFINDIGDAFESNYLLYADDLKLFSTNADCIKKDLVRLSVWCDNWQMGVAPEKCEVISFNHSKKHSNSASLNFSINDAIIPQTKIIRDLGIIFNSDLNFSNHLDVTLRKAHQRVNIFFNVLRHADFEIFIKCFKIYVRPLLEYGSTVFSPTSKEQVRLIESVQKTFIFRVFRKFNIPYISYFESIKHCDILSLEHRRIIIDLVFMYKILVSKEVRIYNDVHISLPRFSNNLRRHPYYIKSKLSNSTKNTCQFFTNRIISCWNKLPPHIFPSFPNSDVFRCNISFNFVEPFLILKHSNF

SEQ ID NO: 2840 - protein, 1066 aa, synthetic construct
  source 1..1066: note = Description of Artificial Sequence: Synthetic polypeptide
  VARIANT 82: note = Any amino acid
  VARIANT 212: note = Any amino acid
  VARIANT 711: note = Any amino acid
  VARIANT 771: note = Any amino acid
  VARIANT 943: note = Any amino acid
  VARIANT 978: note = Any amino acid
  VARIANT 1000: note = Any amino acid
  VARIANT 1033: note = Any amino acid
MLDTADSGRPERRSALIAHELSRLNIDIAALSEVHLHEEGSLKEHGASYTLYWSGKPKTERHLSGVGFMIKNSIASKLENLXTGHSDRIISLRLPLHNKQHVVLFSIYAPTLQADHAEKVKFYTDLRRLTQKVPAGDKIIILGDFNARVGKNYEAWKGVLGKHGVGNCNDNGRLLLEFCAEQQLTITNTIFQQKDSLKTTWMHPRSKHWHLXDYVLVRQRNVGDVRHTRAMPSAECHTDHRLVRCKLTLYFKPKPKRGGIPRRRLKVNDLQKDTVRNSFQVNLQARLLDHPIDPSPEALWQHIKNSILQSSEESLGFSSKKNKDWFDENNQEIQELLTKKRTAHQAHLAQPSCHVRKAAFHLACSKLQQKLRDIQNKWWINLAEKTELCAVTGDHRGLYEVLKAVYGPTHQVQSPLLSADGQMLLTDKTSILNRWSEHFQTLFSASCVVQGSAIQHITQQPVKTELDIAPTLGETLKAIQQLKTGKAAGVDGIPSEVWKHGGQALHAKFHELLVSCWEQGKLPPDLRDAVIITLYKKKGEKSNCSNYQGITLLSIAGKILARILLNRLVPAIAEEVLPESQCGFRANRSTTDMVFVLRQLQEKCREQNKGLYVTFIDLTKAFDTVSRKGLWQILERLGCPPKFLKMIILLHEDQQGQVRYGDALSESFPIINGVKQGCVLTPTLFTIFFSTMLQRATADLDEENGIYIRYXTDGSLFNLRRLKAHTKTLNHHVPELLFADDAALVAHTEAALQRITSCFAEAADLFGLEVXLKKTEVLYQPAPQEDFHHPHITIGESELKSVQQFSYLGCIISSDAKINKEIDNRLAKAYRAFGRLHKRVWSNKHLKKSTKISVYRAIVLSTLLYGSESWVIYRHHLRLLERFHQCCLHTILNIHWTDCVTNVPVLEQAGVTSIEAMILRTQLCWAGHVSRMEDHHLPKIVLXGELATGCRNRGAPKRRYKDSLKQSLSFGHTDCHQXSTLASSRETWRHTIHNAAASFXNTHRISLEEKRQHRKNRALAVPSQETFCCAFCXHTACPTLALSAISVLAASVGRALLKSSFVKPSH

SEQ ID NO: 2841 - protein, 1088 aa, synthetic construct
  source 1..1088: note = Description of Artificial Sequence: Synthetic polypeptide
  VARIANT 129: note = Any amino acid
  VARIANT 831: note = Any amino acid
MTSLTTMAAIATTHARTDWMTNQPNMAERTDNDSLVIGTYTATVHLDSTDNDALLRSHYNLNQVLQTNQQEQDNTPINFSPYYDHEHLIQHLAQPTNNVKFKILSLNCQSLNAKFDQLMILIAQLNHNXVIFDAICLQETWIKESELPPVFNIKGYQAIHQARHCSGHGGLLIFLKDSYKFKIIPFEKSAVWESQFINIDFENGNKDSLLVGNIYRPPHKVKDDLDLFSNQFTRNLLQCSKYKNIAIAGDFNINLLDVNSTTSPAAHDFPSSIISNDFLPKITLPTRISESSSTLIDNFFCKLKNDSTSSGVVIHKISDHQAYFTCLPIRSNKIHNIEKIKMRRVSQESIIAIGNDIRNATGRLDLSTETDPNVNYEALMETLHDSMSQHIPIKEVKFNRHKHKGSSWITAGIVRSIRERDKLYCKLIKAKPNSNKRESIKLTLQLYTRILQNIIRKAKSSYYSMHFAQLKNDMKKTWKAINDILHRNKNSLNRNYPEQFKINDQLISDKNIIAEEFNSFFTSVGKILASRIAHNSTNTATDYLSGNVTSRFVLQKVSESDIERIIAQLKSVSSCGYDMVTPKLLKALSPFLIMPLTIIVNQAISTGIFPDSLKRAKVVPIYKKRCPFIKKDDETVLTNYRPISLLPAISKIFEKVIHNQLQHYFTSNDLLYHSQHGFRPKHSTELAALQLLDQITTDLDANKIPIAVYLDLSKAFDTINHNILLKKLNYYGITGTAYEMMKSYLTNRKQYVSFADCNSRDIMIDTGVPQGSILGPLLFIIYINDLHKSCSNFLPIVYADDTTLYKTINSPNSINSINQELEHVNLWLKIXKLSLNASKTRYMVFHKPRKRLPTLNISIDNENVERCISFNYLGIHLNQNLTWNDHIKRTSLKIARATGRINCLKHFLPKKILLTLYNSLILPHLTYGILAWGAKSNDIAKLQKKSVRIITASKYNAHTEPLFKAHHLLKIEDIYKVYQLNFYFKWKNGNLPKYFNSFSCNTNRDTHSYHTRTTSTVSARVNHEFAKHSLRHSLIILLNQTPNIITDKITTHSYHGFSSYVKNYYINTYTNVCYNSTCYICRNQQQLL

SEQ ID NO: 2842 - protein, 873 aa, synthetic construct
  source 1..873: note = Description of Artificial Sequence: Synthetic polypeptide
MTMYIKDHIDYTMLDIGEDTCEVQAARLLMEQGQATIFASVYRSPNSSKENSDNINAFIRNFSNERAYTLIAGDFNYPTIGWKTMTGRTEADIEFIEALRDGFLIQHVDRPTRGRGSNNPSLLDLVLTKEHTATPTVEYHQPLGKSDHSILDIRIEMKQSETFIKTIPNYNRGNFDRMRRVLSDVDWEEGLGREETTQKKWELFHETITNAVNRCVPKIKIKRKVLKNIPVDNKTLTKIRRKKRLWKQYLETGNQTIYHDYCRTRNQVRQLTRKNMRELEKNIAKEAKTNPKKFWAYANQKTKYRETIPQLLKTGNPNDGMLTENNQEKAQTLATFFNSVFSEKPNDHWNLSPSSYPTIEQDLIITEASVLHHLSKLKKTKSPGPDGIHPRILIEIKEIIAKPLSIIYQHSLDQGQLPDTWKTANITAIHKKGDKRIAGNYRPVSLTSVPCKIMEKIIRKSIMDHLIRNNILSNKQYGFITGRSTLLQLLTVLDQWTEILDRGSEIDVIFLDFKKAFDRVPHQRLIDKLEYYGINGKILTWISAFLINRKQRVTIHEATSAWAEVKSGIPQGSVLGPTLFIIFINSLPDVTSSPTFLFADDAKIFREITKPTDSLLLQEDINNMYHWTLESLLTFNPDKCSSMTISRSGTNHRQYQMNNSPLNKTIIERDLGVILDNRLTFDHHIQAKIKKSNSIMALIRRTYTYLDNHTFLLLYKSFVRPHLEYANQVWKPHLQKHITAIENVQRRATRILPGMKDLNYEQRLRKLKLPTLQYRRIRGDLIETYKIATEYYDTQITQNFFQFNSRTSRGHPLKLYHQPARTELRKNSFKIRIAQLWNQLPSEIVASPSIATFERRLDHHLKNHPKHNPFRPP

SEQ ID NO: 2843 - protein, 601 aa, synthetic construct
  source 1..601: note = Description of Artificial Sequence: Synthetic polypeptide
  VARIANT 578: note = Any amino acid
QLIKDKKAAYYKKLFSEANHKETFQLLKGTTKPPAKVLRQEQEDVTLAFEFQQFFNTKIRKIHDTLQTDENNSPHSHDKRTSASFTAFRTHTQSQVEKIIKSAPSKTCELDPMPTWLLKEQNVLDQVLPWVTGITNSSLELSHVPKDHKTANVKPRAKKDGAAYFDLSSYRPVSNLQFLSKVLERAVASQLTEYLEKETLMDPLQSAYRRGHSTETAVLKVKNDIDLAIDEGDGIILVLLDLSAAFDTLDHAILLKRLEKCLGIKGSALDWIESYLRNRPQRVKVGESYSSDSILQTGVPQGSVLGPLLFLLYVLPLQEVISRFRIDRHHYADDTQLYGRIRLNSIKTIDEDVREMEASIQDVRIWMKKNKLKLNEKKTEALIITSKEMKKHAEGIKLKIGGDTVTATSKVKNLGGWFDEHMKMQEQVNRTTKAGYFHLRTINRIRKNLDTPTCAKAINATVTSRLDYHNALISGARQCIMKPMQRLQNHSARVITMTDKREHIRPVLEDLHWLPVKERSDYKVLTFVHNALHDELAPAYMKEMYRVYHPNRALRSGEDRWTLTVGTAARHEGHRSPXIHGAIMWNTLPEALRSEASHPRF

SEQ ID NO: 2844 - protein, 1205 aa, synthetic construct
  source 1..1205: note = Description of Artificial Sequence: Synthetic polypeptide
MTILQWNCRGFRANFQELKTLVAQKDATVLCLQEIKVKDSDSCSLNGFNTLKKCTLGIDGRAVGGAAVLIKKDTPHQHIPLTTNLQAVAVRVTLHRLLTVCSIYLPPGRSHGDLVELDRLVQQLPPPLLLLGDFNAHSELWGSEEPRPSGRVVEDFIAGNDLSILNTGSQTYLHPASGSFTVIDLSLCSPSAHIDFTWEVDTDQHGSDHFPIFISSECRPSLSHPKWVFKRADWTAFGSLCEIEITEDIFEDVDDPLDIFTTLLIKIAHETIPKSCSSTKCRKPWYTDECKKAIRLRRAALQKFRHHPNDDNLLSYRKAQAVVRRVIKASKRASWKNYISKLTIRSSVKKTWDMVRKISGKYKGHQIHHLTTRSGDTATDKESIAEALADEFALNSSTSHYTDKFQKYKDKAERKVLNFNSNNTESYNLPFTLLELLMSLKSSHDTSVGPDDIHYQLLKHLPINCKMILLNLFNRIWVGEPFPSAWRNAIVIAIPKPGKDISLPTNYRPIALTSCLCKTMERMVNGRLVYFLEYNNLLSPSQSGFRSQRSTADHLVSLETYIRDGFAHGDHVLSVFFDLEKAYDTTWKCGIISDLFNMGLRGHLPVFIRNFLSHRQFSVRLGSVDSSPHPQEMGVPQGCVLSVTLFSIKINSITNAVGADIHKCLYVDDFTISYRSRYLPTAERKIQLALNGLQKWADESGFRFSPTKTVSVCFSGRRGVFPDPLLTLNGQKIPIVEKTKFLGVIFDKKLNFKEHIQFLRGKCQKVLNLLRVISKMNWGADREVLLRLFRSLLRSRLDYGAIVYGSARISYLERLKPIQNQALRLCLGAFRTSPVTSLHTEANEMPMAIRQKLLSVQFALRVCSDTTNPAHQCIFNYNNDRFYLSKPNAIRPLALRIKEDLQTICPDIKAITPNQLFNTPYWLLRPPELDISLIHFGKKTANPNYTLRNEFYNLMDKYPDHKVIFTDGSKSDSAVACSATADNLRIQIRLPDSASIFSAELLAIYQVLTLLECSANDQQQFLIATDSLSSLQAIGNFNIKHPYVFKILEKCTLLHKKGIDLVMAWCPSHVGVMGNERADLLAKEALSFTTCTIRIPSSDFKPITHEFYKEKWQEQWSSEQENKLYCIQPTLGKWAKSSREIRREEIVLARARIGHSHLTHGYLLRREMPPVCIPCQSILSVKHIFIECVDFDILRRRFFNVSSMK

SEQ ID NO: 2845 - protein, 538 aa, synthetic construct
  source 1..538: note = Description of Artificial Sequence: Synthetic polypeptide
LDCPQIPDPHFTVENVLSVLASLDTNTAFSPQDIPPIILKKCRSLLAPSLCIIFNVSIRCKTVPLEWKKARVVPVFKKGDKSAVSNYRPISILCIVSKVMERCVFNHMYPLLSSFIHPLQHGFCKGRSCTSQLLDVYNRIGSILDKGGQIDVVFLDFSKAFDCVSHKLLLYKLKHFYGVDGNLLEWIRSYLSERSQSVIVEGKSSTWLGVPSGVPQGSILGPLLFLLFINDMPYKTLHCTTALFADDSKCFKSINTTHDCELLQRDLNAMHEWSLIWQMSFNPSKCKVLSITRSHAPIHFNYAMNGVILDHVNVFKDLGVFIDQTLSFSTHIESTILKCNKMCGIVKRTIGFNAPVNVKSSLFMSLCRSHLDFASPVWSPHLKSKVKQIESVQRSMTRFILNNADLSYIERCQFLEILPLSFRREITDLLFLFKYFNGAMNVDFTSIVAKRCFNTRLRSGPFIELLTPTPRTDSFINFYFNRVAHMWNILPLEIRSCLSVSTFKSKLLSFYSNKMCFYDVNNSCTWTSTCRCNGFYHT

SEQ ID NO: 2846 - protein, 1075 aa, synthetic construct
  source 1..1075: note = Description of Artificial Sequence: Synthetic polypeptide
MWKVIFVICVLSQIKAKTGSGETRPGFTICLPQPRHASPTSMPSLCLEFIRALAVKAPARLPTDLYKRLNGLRISRRRLSKRGTKGYGRGVIPVQVSALRSADRYVNTARRDASLPTSLVTIEPMTIASSSSCVLLNCRSICNKASEIRDFISDRRMDFLCLTETWLTGTDEDKVVSAALLPDDYAMVHRPRDARGGGVAFIHRRSITLSQIRLGDYSSFEVLDALVCTARRLRMCVVYRPPPSRRNNLTVAQFMSEFADFLSDIVSLPGEPLIVGDFNFHLDDCGDADASTFSDLLTSFGLKQHVRGPTHEKGHTLDLVITKTDTALIWSSVSRDLCISDHYPVFTTLAIPKVLNPTREISYRRIKAIDKEQLDRLIEASSLSSPPENASLDENVTNYQRTLTGILDTIAPLRSRTVRIRVNADWYNDEIRAEKQRRRQAERRWRKSKLPADRELFKVAKNRTQSMIDEAKSLHFREKVSACSDDPKQLFRVVDTLLGNSTESPLPVHDSRVELSNRFSDFFVEKIATIQSAIPSVDNPPRPQAPLPQSQLATFQPLDVADTCALISGAAPKSCELDPLPSPLVKDLPSLRPIITRIINQSLATGVFPMEYKSAVVRPLLKKPSLDRDSLKNYRPVSNLSFVSKLIERAVASQLASHLRNNDLMEPRQSAYRPGHSTETALLCIHNEIVCAIGEGKAVLLVLLDLSAAFDTVHHPTMLSSLERLGVTGTPLKWFESYLSERSQAVQIGDAKSDPAAINCGVPQGSVLGPILFTIYTSSLGALLREQGVSYHLYADDSQLLLTCDPRDPAPAVARMEACIRSVQAWMSCHSLKMNGDKTEILLITSKPMRKVLPDVQLCIDGHQLQPSTTARNLGVTFNRHASMESHITSVCRLSYMQLRRLRRIKKLLPRDVLESLVHAFVTSRLDYCNSLYLGIPQTQLDRLQRIQNSAARLVTDSGAREHITPVLQDLHWLPVKERVIFKVLLIVFKSVHNLTPQYLSEMITVHIPTRHLRSSNQNFLTVPFTRSSFIKNSAFSVAGPTIFNSLPINIRQAESVPIFKRLLKTHLFHNYFLT

SEQ ID NO: 2847 - protein, 659 aa, synthetic construct
  source 1..659: note = Description of Artificial Sequence: Synthetic polypeptide
MIYCLPTYIRKLERQKPMIKTIRQWTEDAAEQLGGCFACTDWNIFEDTTTNINEYTNVITDYIKFCEETIIPTKEIKIYPNNRPWVTNDLIHAVRKRRRLWMSGHHEECKEAQKEVNTIIAQCKDNYKKKIEESFRSGNPKKTWSGLNTITGYKKKPMTRTSISNDEGWANELNVFYTRFEKEDEDLVFDQPAIAPIRFEEEDVRRVFMGIKQDKAQGPDGLSPRLLKACAQDLAPVFTGLFNRSLEESCVPTLWKCSTIVPVPKRPTAKELNDFRPVALTSIVMKSMERLVLRRLLHQVQLSMDSNQFAYKARRCVEDASALMVHLVSEHLETPGSYARVLFVDFSSAFNTMRPSILISKLEAQGVAPPLCQWILSYLKNRPQQVRVNQSLSTIRHTNIGAPQGCVLSPVLFTIYTDEHRATSQETRVIKYADDTALVALLSPGKEHLYTDAVSHFIDQCDNDDLKLNSTKTKEMCIDFRTHNTIITPIIIKGQPIEQVTTYKYLGITIQSDLRWTSHISTQCKKASARLYHLRKLRQFHVDRHLQELFFTATIDSLLLFGITVWGGRCTARDRNNISRVQRIAGKIMNTTVQPWGVSHRQRTIMRAKKIIREPLHPLHYTFQRLPSDRRYRALKAKTNRLRQTFVPSAIRLINSQPI

SEQ ID NO: 2848 - protein, 758 aa, synthetic construct
  source 1..758: note = Description of Artificial Sequence: Synthetic polypeptide
MSLTHEHLSIKVIDVDRSVTSDHFGVVFTINCPKPAREKQKLKVRKWKNVNISALDETIASHIPAIESAQDPFAAYNNCLTQVVDEFAPETTIEVTKRTDTPWYNAELRHLKTECRRLERKWRRTQLKIDQEIYRKKCRCLRRLRDRTKMTYISSKLQNATSTKDTYNILNQLLHKQSSSPLPRHDDEIELAETFSSFFSEKIERVRSAIGAHPDPDVTIEHHLSTEITPLTSFRPVSRDWISKTLSSTTPKSCNLDPIPTALLRKCPSAVPLLCFTINWSLANSTMPDSHKTAHVRPRLKKTSLDHDQLKNYRPVSNLSFISKMTEKAIVAQLKDHCFVNNIDVQMQSAYRAGHSTETAMVRVQNDLLDAVDRDGGAILVLLDLSAAFDTLDHPLILHALKYNIGVTDSALKWFESYLTNRKQLVTIGSQTSDTKNLVYGVPQGSVLGPILFTMYTRPLSNIISNCGMNHHLYADDTQLYIAVNVRSPTSVSSVKESIQECSNQVHRWMTANFLKVNEEKTEVLVITKPSLTEIAPSSFNIIGETITSSASVRNLGVMLDNKLSMADQVRNICQKSFFHLHMIRKIRNFITEDAARQLVHANVMSYIDYCNALLAGSPSYLIDRLQHIQNCAARLVKCADRHSPSLPLLKELHWLPIKFRIMFKINVITFKALRGLAPPYICSLINVYTPARSLRSSNFTLLSVPKFHLQSYGYRTFAHQAPILWNRLPSNLQNQQSLDAFKAQLKTYYFNIAFSSI

SEQ ID NO: 2849 - protein, 693 aa, synthetic construct
  source 1..693: note = Description of Artificial Sequence: Synthetic polypeptide
DDLNDLVSSFNRRCLDVTNAHAPLRQITLKGDGMKPWYSDAIHSARVVRRKYERQFRKSPLEVHRQIYVDQCKEVVQLIQNTKKEYFHQKFASASAKEVFRLVDNLLHKEPNHTLPTNVPLGDLPQTFNKFFYDKVHQIRAELDASPTLPSLTTPQPLVAERGGAPALETFEICSAEDLRKIIQTSGSKTCMQDSIPTPLLKEGAVLEAALPAIVNIINRSITEGCVPAELKKAVIAPILKKTGLDPNNLAHYRPVSNIGFIAKVMEKVIARQLTDHLTRHNLHDQLQSAYRKGCSVETSLLYIKSDIELILDAGDAVLMILLDLSAAFDTIDHALLLTRLSEIGLEGSALAWVKSYLMERTQVVRIGDKISESSDLDIGVPQGSVLGPLLFLIYMIPLGSIIDNRGVLRHSYADDTQLYCRVNIKDPTKLQKQIRDMEECITSVRSWMKSNKLKLNDAKTEVLLISRHEPRQPVEIRVGNAVIKPAPLVKNLGAYLDCRLSMKDQVNRTTSAVYYHLQRIAKVRPFLSDSACANAINATVTSRLDFQNALLMGLPDCQLRKLQVAQNNAARLLTRTKKREHISPVLTALHWLPIKHRIEFKVLSMIHKSFHSLSAPDYLKKLCRPYVPSRNLRSGDDPFKVVQLRTRNLYGARTLGGLGARLWNALPMSLRKPMTFSTFKKNLKTHFFRISQ

SEQ ID NO: 2850 - protein, 793 aa, synthetic construct
  source 1..793: note = Description of Artificial Sequence: Synthetic polypeptide
  VARIANT 14: note = Any amino acid
  VARIANT 40: note = Any amino acid
  VARIANT 97: note = Any amino acid
  VARIANT 99: note = Any amino acid
  VARIANT 102: note = Any amino acid
  VARIANT 202: note = Any amino acid
KMFLDLMHSHAFFXLIDKPTRITATTSTLIDNIFSNVINXTHLSGVLYTDISDHLPLFTVNQFICRNNSIVTKTIGYRSFNETNKLAFQNAPLAIDXDXLFXCHNCGAAYTLFTSNFVDCYNESFPIKSHKINPKRNQPWLSPELKRSINRKNRLYRRYHARPSVFNEINYKSYKSMITKEIRVAKRTYYHDLLEQNRNKIXKTWDIIKEVIGIDNTKKPIASITINDSTVSEPIEIAQHFNKYFSSIGNNLASSLPINHLDPMRYMNPNTPRSLFLSPVTSNELYTIIFNLKDASAGIDDIKPIIIKEFSQLIIKPLLHIFNLSFTQGSVPCAMKKANVTPIFKGGDPTSLGNYRPISVLPVFAKILEKLMYNRVYNYLTENRILFNKQFGFRRGYSTEMALLTALDELSSALDMKRNVIGVYLDLRKAFDTVNIDILLAKLFKYGIRGIAHQWFTSYLNDRSQRVKIGCSFSEMKSISCGVPQGSTLGPLLFLLYINDLPNVLTNIFPIIFADDTSLFMTGVDINDMTEAFNHQLSKINEWLIANKLSLNIQKTYSMLFTLSPHLYSSPIPITINNTEIQRVHSTRFLGVIIDDRLTWANHITHVSNKIAKSIGIINKVKHSLKQDTLMILYYSLIYPYLTYCFLLWGKASHSHINKLTILQKRVIRIITNSGFRDHTRPLFNTLRIIHMDDLFTYLCSVYIFKCIKIIFPRSFLDILNYFTDYNSNAPRSSTRASLTRSIIVPLCRTTLRQKQLRFQSIKLYNNFLMPLEILDNSNSISHFRRFLKNVLS

SEQ ID NO: 2851 - protein, 661 aa, synthetic construct
  source 1..661: note = Description of Artificial Sequence: Synthetic polypeptide
KRNQLTRATRRAKIKYYSDKINESASPKEIFQVTSFLLQSKREVVLPKATTMSSGSLADEFAEFFENKITAIRNGISAAPVQSSPLSDVVALHTFALTNAEEVSTLIRKSTSKSSAVDPIPTWLPKKCILTFSPILAAIVSASLVSGCVPDQLKAAVVTPLLKRPTLDPEVYKNYRPVSNLSYVSKLIERVVAERLKEHCALNNIQCKFQSAYKQNHSTETALIRVHNDILRAVDRDGGAILVLLDLSSAFDTIDHTLLLHHLEHQMAIGDTALKWFSSYLSERTQRVKVKESLSSPRRMLYGVPQGSVLGPVLFTLYTSPISAIIRAQQLQYHLYADDTQLYMSFTPTSAASTTSSGASMESAVSAIKRWMDDHYLKLNEDKTEMLVIQRPNPRSSQPTHRPTLTLDGNNINPSTSIRNLGVLFNSAFNLEDHVNALCRTMFFHVNRIWRIREYLTTSATRALMQAHVISRLDYCNALFYGLPVVVRNRLQKAQNAAARVVVRAKRSDHITPILLQLHWLPVEFRVQYKICLMTYKALHGLAPAYIDELISVHRPTRRLRSSSDIRISPVQYKLKSVGGRCFSSAAPSLWNELPQSIRLSSHLLEYKSKLKTHFFRKAFNDIYLNKSTSYHFIYILLYIAFEQFYFFLNFAIHKFEVINK

SEQ ID NO: 2852 - protein, 508 aa, synthetic construct
  source 1..508: note = Description of Artificial Sequence: Synthetic polypeptide
  VARIANT 379: note = Any amino acid
MSDHFIHGCPELYVHLSLFLNAMLIHLDVSSVMSRSVLVPIPKNRKKSMNSASNYRSIAISSIVGKCLDNVILVKHADVLSSCDLQFGFKRTHSTTQCTFVLNEVVDFYMRGGSSVYVTLLDATKAFDRVHYTKLFRLLVDRSMCNATAKLLLCMYVNQSLVVRWQSVTSDSFPVTNGVKQGGVLSPMLFCVYIETLLERLRRSGIGCYIGSTFAGAIGYADDVALLAPSLITAQKMLNVCEDFSREFFVQFNSSKSKAIVFNAPPNAVRSMRKLTLNGSPIDYVADALHLGHVVGDKSASLNMENACRDLVVRVNMLCSNFNFVHLDTILLLFNSYCTSYYGCSFWDFSPRTINGFVVCWRKCVRRLLDLPYRTRSKXLHLIVLKPEPRHQLFFRFQSFYVGCTTSTNHIVSLCTRLLPFSSSSVACNLRQLMSFVNINYDQLNNLIDNHSIRKRLSEFCEATTDQESLCCASSVIELMKIREGSLISPINPTEATDLLKHMCCSND

SEQ ID NO: 2853 - protein, 722 aa, synthetic construct
  source 1..722: note = Description of Artificial Sequence: Synthetic polypeptide
  VARIANT 202: note = Any amino acid
RTGSSRHSMLSLLLPASPMPWKSSETLTTLLTSTHTTKYLPQHLTDMHLRKPESSHYALTLLGTMMNSEHQNMSEKEGTQVENKWSRDRKETYKEQRDIYNRLLNQTKTQYYSKMVTDKARNPKDLFQLVDLLIHGKETNPVLPEHTSLDELSDRFATFFSEKIETIRLNLSNRQTDSQLLVHQEAEPELVSSWMVFSRVTXEEVTRVIKKSPSKTCSLDPIPTWLLKACLPALCETITAIINDSLSSGYVPDSMKVAAVSPILKKTNLDQNELKHYRPISNLTFVSKTLERIVAHQLNIYMAENHLHEQFQSAYRQHHSVETALVRVQNDILMNIDRGDAVLLILLDLSAAFDTVHHDTLIRRLEGIGIGGIVLNWFRSYLKDRHQSVTIDKHSSPRRQLGQGVPQGSVLGPILFSIYMIPLAQIIERHNMSGHYYADDTQIYISFRPSSPLADIEAKANACCSEIQQWMARNMLQLNEGKTDVILFGTKNILRTLDQKASISIGGSVVLSSASVRNLGCVQDSELKLDLHVNQICRSAYYHLRNINKIRRYLPLDVTEQLVHSFVTSRIDFCNSLLIGIKKANQQKLQRVQNAAARCILYIKSREHITPYLHALHWLPVEYRIQFKVLLLTFKSLNNLAPAYLTSLLHQNAVLASSRRNSSRLLSIPRSRLVGAGDRAFQHAAPTLWNASPPAMRTLSDVNVFKKGLKTFLFRRAYSDYC

SEQ ID NO: 2854 - protein, 693 aa, synthetic construct
  source 1..693: note = Description of Artificial Sequence: Synthetic polypeptide
  VARIANT 297: note = Any amino acid
  VARIANT 406: note = Any amino acid
  VARIANT 590: note = Any amino acid
ISSNDPCDAYPRFLNKITTHYESSFPIIKKKPKKRDNNKWITNGLIISIKYKNKLYLDYKRHETIANELAYKKYKNRLSGIISQAKKNYYQGLIDENRHNMKNLWRTLKELIGSKKRSSLSNEFLINNKPCKDKDMISNTFNQYFVNVGPKLASIIPNVDSNPEDYLSGSYPNSLFLTPVTINEIKLALNKLKTTASAGQDKLKPNIIKLISDEISLPLTHIINLIFEHNKVPDEFKFANITPIYKAGNSMEVQNYRPISVLPAFSKLMERLLHDRIYVFLQQNEIISDYQYGFRKXFNSEMALAVTTDNIISSLDSQKHVMGLFLDLKKAFDTVDFNILMKKLVHYGIRGNALDLLKNYLSNRKQSVKIENSVSSELPVTCGVPQGSILGPLLFLIYINDLPNAXTSCNPIMYADDTNLFLSGKNIDEMENKFNTDLVALTKYLKCNRLSLNVSKTHSMLFTLNNSLRDSSLSLSIDGSIIDTVKCINFLGVKIDNKLNFSEHITHTCNKVSKSIGIIRKISKTVNRPTLLMLYNSLILPYLTYCNMIWGKSANIHINRLFILQKKALRLINKAPLLTHTAPLFHECSXLNIHDLYIYRSTIFIFKLSHHMLPTPVSKFFNLTPLVHGLNTRRQLNYKVIVPFCRTSLGQKSLNFNIAKLYNNILQPLSLLNLDSLEKFKKSIHCILVAKYL

SEQ ID NO: 2855 - protein, 468 aa, synthetic construct
  source 1..468: note = Description of Artificial Sequence: Synthetic polypeptide
TLKIAQVKPRPKKPGVNTMDPKLFRPISNLPTIEKLLEKCVIRDLHLYIQQHNIIDPLQSAYRPGHSTETAMLRIQSDIKTSLDEGNGVLLVLLDLSAAFDTLDHNILLSRLQNSAGITGVAIDWMKSYLSSRQQFVQIEEKRSVTHDLDIGVPQGSCLGPLLFVMYTTPLGAIFRKHGLSYHQYADDTQVYCSLPSDDQNSLKNVLTRVEKCLDEVKCWMTQNKLKLNESKTECIIFSSKRNKQLFHQTTIRFGGSVITPVTSVRNLGAHLDCEMSMDKQINNTIKSAYYHLRRIAKIRRHLDRSSCTQAVVAFVSSRLDYHNGLLAGITQKNINRLQKVQNHAARLVSQTAHHCHITPVLADLHWLPIRARIDFKLMLNAHKAVHCNDAPKYMKELCMKYTPSRTLRSSSDPHLLAVKKSKRNIGASTFDVYSCKTWNELPRDVRDIEETICFKKTLKTHLYKRCF

SEQ ID NO: 2856 - protein, 1053 aa, synthetic construct
  source 1..1053: note = Description of Artificial Sequence: Synthetic polypeptide
MACEWDGKNSLLKLGSENQPSVSDVSISAMQAPPVAQSPVVSTARLSTLALPYAQVILNVPTAKASTRHPASPVHPTSKPKKENMDSHNIWITNIRGLVSNFDSFRLEIEHAHPYLVIVTETFLSPDVPDQALLIPGYSFLRRDRRTHGGGVALYYRSSLRLRRLTSLETQDHEVIWFQASTREHDIIGCAAYWPPGSDLDITQHLQHALDEVSIEFNTIVLLAGDLNAHHPDLSESISTNTAGRLLQRFATVNALTQVIQAPTRVTAHSSSCLDILLTNIPEEINFLGVYPGIGTSDHGVACVDLKTTSVITHTEDSATIRPRLHFNTHSTNWKTVNDHFSNINWHHRFAACNVEETWTLFKDAYEEVLGRLSKKSRPTSRRTNHERHQHNTLNQELIRLRATQQAAWRLHSTARTRETHQSLVTARQEFTLACANHIRRTDEATVKRMTESSNAKQWHKYCKQLYRGSAVKEAIPIMTVGTESYITAKDKATILNQTFIAKSRASSRPRFPSLKKRTDSTLADILFNEYRVKKILQDLNINKASGPDGIQPSTLKNCSDSLHVPLAILFTKSFTEGVVPTEWKLAAVVPVYKNKGQRTDPNQYRPISLTSCVGKVMEKIINDALLQHLMGNELIVDNQFGFLPHHSTTDQIALLLHELLAATTTKKSVVACFLDLAAAFDSVPHPAILQKLPAYGVRGRLFRWIESYLSFRTQYVVVDQSSSPIAQVSSGVPQGSVIAPTLFLLFINDLCHSLSANTSLSHPDCHPEALVYADDTMLYRTGKDPALICPAIEEDLRIAAKWADIWGMRFNASKTVAMYISRTTATPPPITFAGATLEYSHEHRHLGFILDSALSFHAHVNALTRKGATEVFLLRRLSYKVKDRDLLLKIYKMYVRPHLEYASPAWAALTVTQTGLLESLQRRAMRIILALPRNHHITDADYAALNITSLRHRRNFALACFMFKLNSNRLPRKLSKYRPIPHTNPYNTRNCVLRAPYVPYPCLRLLDRSPFLFGLKILNFISHTFHSLPDISSFKSSLRESSYYMPLAQIYY

SEQ ID NO: 2857 - protein, 650 aa, synthetic construct
  source 1..650: note = Description of Artificial Sequence: Synthetic polypeptide
MKNSIKMKNKLYCKYLKTKNPNDQKQYKSYKITLRSILYKAERTHYDQLFCRNKNNLRKSWEVIKTVIHKQKNNNKQQYNMEVNGKKTSDLDIITKHFNEYFINVGPNLSKSIPYSNIDPISYITQTNRYSMFTKPTNETEIGNIIRALKNSAPGPDGIPSSILKENTAHFIQPLTHILNLSLSQGIVPNEMKIAEIKPLFKSGNKHLVNNYRPISLLPAFSKIFEKCMASRLIEFITKHNLLYQYQFGFREKHSTNMALHLLIDKITNAFDQNKVLVGVALDFRKAFDTIDPSILISKLEKYGIRGCTLDWFRDYLHNRKQYVHLEGIKSSPLSIKCGVPQGSILGPLLFLLYINDLPQSSQLLPIIFADDTNVFYSGDDSEECIGIINQEMINLIKWIRSNKLSLNVEKTQYIVFSKRKIAPDNNDVNINGERLNRVDSFKFLGVIIDDRLSWKQHIAYIKTKVSKSIGILRQARPVLNKTTLLTVYYSFIYPYLNYCIDVWGHCSKQDLQSLFIVQKRAIRIINYAERNAHTDQLFKSLEILPLHHLYIFSVIIFMHKFHHKRLPPVIDELFQTNASIHSINTRQRHQLHTPLLHTNISMKSIRYRGAFIWNQTFNEIDTNLTINRFKTCLKNKLFTDFPIRTSPIQ

SEQ ID NO: 2858 - protein, 882 aa, synthetic construct
  source 1..882: note = Description of Artificial Sequence: Synthetic polypeptide
  VARIANT 22: note = Any amino acid
MVPDVNPSFSIRAEDCRYIAPXEIPNLCEHYTHPLRILHVNIRSLRANYDELLNLIASYEESNRALHVLLLCETALSDANTVLFGIPGFDAVYANRKSHQRGGVAIYVRKGLNFTQRPDLSIFSEGKFETIFIELSLCQNSQPIIIGEIYRVPSLNAPETIAFFDSFTSLLHRSNASIIFGTDQNLDLGKIDEHALTRNVYNLLESEGFLPTVNVPTRIEGVTKTIIDNIYIRGSLPSARTSVVEVKIADHLPIVLTVDFHMHRKKNSPLVIMHRKMDETIAQRIVDELGQCDWQSNENRDIDSAFEFFLSEMTRVLDRHAPAKQIKIPSKSFRREPWFTKGLQRSSRRLSKLYSTAAKCAKNSHQHTAYVKYRNVYNSAKRAAKQLYYDNLFSESKNDIKRTWKILNDLTKKSGKDNSPVEKLQVDDVTITEPKAIADAFARFFADVGPKQAGLIASHVQTDDQQNRAHLGVPPSHHSVFLHPVTQQEIIRIVDSLKNKKSLGLDLVSTHFVKKLKHALSAPLSALVNKSFCEGAFPNLLKRAKTIPIYKKGERFNMDNYRPISLLPIFGKIFEKAYCNRLMPFLEDRGFLCDSQYGFRRKRNTTYAVSELYLNSINALLKNEITLATFIDFSKAFDTISHEILLNKMPSYGIRGRALDWIRSYLSNRSMKVSIQGCLSEEVQLSQYGVPQGSILGPILFIIYANDLNACLTHTKAIFYADDTTLFLSGKSANVLAERMNDDLGRAKRWCEANSLAVNIKKTKYMLIGPNALTRCTIDLSMANEKIERVTTFKFLGITIDERLTWKAHIESLSKKLSSGLYALRNTKRLTSRHGLLSLYHSLIHSHLTYGCLLWGSASDNALKPLKIAQKKAIRLVYDAIV

SEQ ID NO: 2859 - protein, 2548 aa, synthetic construct
  source 1..2548: note = Description of Artificial Sequence: Synthetic polypeptide
KLGPTPAALAQDPPTNPTGGPPAGPNTTNSPSPPTSANPGPAARSNTATRIVPKPAGPTKRPARRTPNPTPKLRKLATGTPSAPPPAKRLHQTTIATSHKRRHTATLQNTPTEPTNGQAQASPSPPPDGRISILTLNTRELLSHHESILHTVTTHTPDILFLTETKIPTRLHYSMGSAKKGLSSHYQTYTSNAPYNPREGTRPHAGVMVGVTHRFSRPSGTTDMNAHNTDSRLAGHVCHIRIAPPHSTPVHAIGIYAPSDDATRAAIYKYCTDQAAKTTAAKEHLLIGGDWNAVLFPSDRSTGQLNATDRAHIAFTTSAGLHPLTPPTHEHPRPHTYLQDQATAPHMSRIDDLLVSHHTHATITTTGGGQEAVHECGDALDHRALLSSVPLAALRLYPFPTAPAAPSDPDAWVNYHPPTKDQREKARIKMEETIGQEIADLLNTLHPAHLAITNKLYPAGLTPAQAERNTPSPAEFRALPEVSAADTTSISNTLESILQKCLDVLKSYCDKKPPRASTTSPRHHTSKTVTRLLTATSKLKERLTAALTVTNAAGATPPTTSPHPAPTPPPNTTSPTPTPPTPAEADTPTAIRSQLLNARTLLRAAKKEARKLNTKRAARAFRRLVATQPKRAHQKIFDETDQPRGTPALTDPTTKEVHTAPEKILSSIHQHFTAQLLPINGPRTGHYDIPHSEKQYPWSRPDAPDRMPALSKPTDAPATLLPGIADSTTFFGCVNHLSRRKAPGPDGIPNELLQTIPTSLQTAIHQLMTLMWVKAHIPTHWTQSDTVLLPKKGDPLLIQNKRPIALANTLYKLYTSLITVNAALFSEQAHIFTESQEGFLRGRNTERQVQNLLHAIEDAATTGRDLFLLYIDFTSAFNTIDHDKLLIVMHDLGYPTDLIEVVRDLYGKAATSVRTEHGTTPPIPIQRGTVQGDVLSPLLFIIFIEPLLRWLHVGGRGYQYGCLTKAENDKHNLSSGAFADDLVTATTQISNLRIQVEKIEKYAAWGGLKVNVSKCQLQGILHGRARADPTLGGPRSKPHQAALARMLEGQIRIDGTAIPYKPPHESYKYLGIHITPTLDWSAQVQYIREKIKKRGQRIATSLATPDQKLRMIQLTIHPAVAYSLPFMPYSTHDVTSLDSLIASTAKMCYGLKRGFPTRAILQPTNALGLGVGSIRELYVRRAGKALVQALNDGGRLGAVTRAMLHLQHSVAQKIPADQLRTQCRFYTSLRQLSLITDAGLELTQQGSAYHTTLHGLSALLARTVPPGADAEQALPFRLIQPLLELTSDFRELLTPDRTCVIDANTLKNTWPRAQRRHRLALNRLTLALHAETRTRAKTHNSTAPLTTAQRTLPDGHTFTGLHTAHTAPAAVDWGTLNRFLRQRAPATGQTANAGETAAATTAAATTAAAEPEEDHHAGENHAPAQTRRPGTQQRKRACIKMVREPEGRGSPPADAPAAFDWDPSLDPLTEAHCADLIHTAPSLLGKSKPQNPAAHLRGLLLGPTPPATFTHRHKLSQEEQDAYLAATSDTWKHFSETYRTKALTTTNTLYGQQERVQQVIAHTTSKGAPFYRVQWEPTVITPGSLTLYARNRYRPKPGGLTWLLTPGNEPRVLVEWEDLEEPAAILDAQDNKQELLDALNARLAVPLGPRPPPPATDTHLSHDQRQGRWTDASNDTARGQRTLRHYVDINVEPCNPSRDIHPTQAYTVQLGTVLDPGSPACGTHLAHVYDPRGRCIGTISAEQLSLLWQRYQHAQTTWPKVHAKHDQGRGFAAAIARLLLRYKPGGGSKSHPVTEKGECMLCEGLTQTLHTAIGSTTELFASPLNVSDAATTYYTLYEEDMLFGANYDAYSQPWDGVAVACPEPNTEDGAHAVRWALAWAEHTETLTNTRNPPTTATLLILPTQRNAPYTRYLAHPRVTLLGSISATTTHALLGQIHNDTGITLKHDLVLVSNTPGAQLAQPIRDALGTSLYLSGMPVDPQPQLTWAHTRWVTKQVRRMTRTRPAAPRVTPPPVPATPATLAPFAATQPLRLNPYEGFYTDGSVQKDALGQPSAWGAAAIDARTLRCYQIDVNPGQHGCNTITRCELSAIHQVLKLDEVQALPEVTVYTDSAASLFLIRKTINQPQLLTFSKHKALLDNILALLKRRSHAGRRTNLLKVKAHSGIAHNELADQAAVKTAKGEQIPGAEWLVEESDNDPRSKYYWIRKIIKPTVEGVPREKNEGHYAHDLNRGIATLAAPHIAQGHTRETLYTGFVANAIPDLDIKSSTRTMNLQSGRHRKAKRCMDYLYGQLWNNKLAARFGRTVTGRRAPRAGPDTPAPCPLCRGPDSGGHILGGCHNPQLRAMYIKRHNIAVQTIARAISRGDCGGCYMVMDATSKADLPDYAADNRLPPWLLPDQEGKPAGRHLHYRPDILLIPSISLAAALNPDFVVLPSEHDTIHIIEAGYTADTNHAAKQHEKAQQHQALAADLREAGWKVQYTPQSAISLGFAGTIRKDLHPLLTSLGVTSHKARQCCDTLHDHAVATLNHIVLTRRRLERGLPPGDPGGT

SEQ ID NO: 2860 - protein, 1484 aa, synthetic construct
  source 1..1484: note = Description of Artificial Sequence: Synthetic polypeptide
QWGWWRRRWRRHAAGGGGRPCRCAPRPRPHRGDLGCPAGGSAVVRRPRQQAAGPRPLRVGSHNVRGLRSRVQHLGCPRLHALLRCWERQQLDVVCLQETHVRAEDIDLVTADLRAAALRLHVREWTAWWAPAPTPHQRVSGGTAILIRTCLLEQGAVTFPGGVAAPSVADGAWVGRGVSLPVQWGGHDFTLAAAYYPLASPEQRAFTQQWVASAVGGEGNHLLAADFNFVSDVALDTASGVPRPGDPAAATALAAACPGLIDVLRVRRPGQRVCTYIHSHGASRLDRILCSGSLVAQVLACAVEAGVPSDHRLVTLTLAATPEALPPSPGLPKARLGFLDFKDLTKDYRTWLTAALGARPGAPAELLAWWPQLKRAAAASAARLSRVAAVRRIAASEEEARALAAAAAAAAAVEVGAALPEAAAAAVRARCAAATAAVQAAAGAARRTRHEWLRGGEKPCPVLTRMLRPSGGPRTIARLKRPDGSATSDPTVMGQVMATYWQDVCAAPPPAPAARAQVLAALQQHGRRCTTEEAAQLGQLAVTAAEVRAALAAAPAGRAAGPDGIPVELYQYYESDFSPVLADVFTAVGEGAGVPGGFLDGVWTFFYKAGDPLEPSNYRPITLTDTDYRTLARVLCRRLQPVFGRVIDPEQTAFLSDRRIADNVLLLQLTPGLLKAAGQNSGVAAFLDFYKAYDTVDRSFLLACLERMGVGAGFLTWVSRLLTDTRGAALVNGRVSGWVPLAAGVRQGCPLAPLLYLAIAQALLSWLRSKGHGVLAGLASALASQYADDCTPFLAGMQAVPGFLADMDVFRCASGQRLNMSKVELLVLGTSAGLGVAPAAVAGPPLPPGWRVVNTAKSLGVHFGDWKTATPPVAFDGVVGVLGLIVRMPVSMFGRAAAASAYALSKVLYHLEFAGFPSPWAPVGKLLGQVAAVVDRRLSPAKYAVAPHARPVGVSLDIMQVPPALGGVGLLPLQLHVQARQAGLAVRCVLGACGLLAFVPPWTKVAEAWLRARHPAATPLRLLVRCDPSRVLDKLVTPECKPFLRLLGAVAHLPPITLVAPPAAGDWVYHVPLWANPALCDGAQTFDVAFADLFALPGLVYVGQLVAAHDQLEAVRAAHTRPGGWGTRFGEAMLDLYLTSVWRPVLGWGPRRHLPSPLLGPASPLAAAERIAAAVALLPGGWEAAARAARLARGRAWVMPLPADAVRQAAAGALTQVVRGLGWVLDGGPPLLLLNYSVKAGTAMQLGPQVAALRSKHLLYVRDAGVSADGALAAAGAFAGTLARLWALKWENYHKEALWRVAANACWSFPKNAAQRAAGVAMPLCRACGRDMCDGDRRHYFWDCVVARALRENMAMAMLGSPPDTADDCFSRADLWLVQPPAGLAPPVWDVVCLAALSALDSGRQQVIMTGLRVRRALTSAEVMRISVSVIADFWGRLQSYVSLGLRPKAWATVPAHHPFLSRGAGDCVLLVLPDDVGSPPPSP

SEQ ID NO: 2861 - protein, 3134 aa, synthetic construct
  source 1..3134: note = Description of Artificial Sequence: Synthetic polypeptide
MSSNPMTLQIGTQPGQQQPDLTSPSHPLRGGNNTERTTTPAAENGHIPVPLSWPRQIPSTYFREQQHLNFCTIHAINNMLGAPWLRAHAVLAFCQVVHTALADTPELQATWGHHFKHNGLFHEAAINHYLRHRPAPIDTTGTRLLLRLAAPNLDPGHSQDTILGLLPECSRNMGFMVHDGRHAYAIRKEEDSWFLVESFVHIGRKPMTPDLWQAVKGDIFCLHPYHLDMPLDPRTYPTIPNLPPPPQPPSPPPPNQTKPKRGPTQRALSTMFARQTTQLPTNHSAGDNAAPTPHPGPAETTVTRPLTQATLNITRREATEPARTQNERPATPNSAARPTRRPRHDNQLDPEPTSPTRANTTTRPRANANMHAPNTNPTQPTANNTTQPTWAQVVATHAEAAGNALRTVGRITTQAPHQRPETPPSAARPTQRPRADPPDSPTTHQTVNPNTPRRTPPGPTPDPGAGAQDNTETRPDNTTWLHIATHNVRGLGTNLLSTICHLREWNADIVILTETKLGPRTRWLKDTLRQEKLSYRTFTSTKPGTEQYKRRSAGVLMAISKRYHSGSNVHTATIPPHLHGYIVHCTIRTPHSTPLHILGVYAPEDMPTRRRIYKYCEETINTANKTDAHVIIGGDFNAVLNEGDRTGPPDEADKHHARFVSKNKLKRLPEFGGTISMSFYQTRDGTPQPTSRIDDILICQNIHSALPTASRTPATLQVQPCGGLFDHYSLHARVPTFPIRLWPSHTATQADTQPPETPGPWRTVVLPIPKSTLEAARTKIEHTLANPIATLASAIQPATTAIQQHLAQHTAGATNASELQHALQTDPAIQTPDLDALANQLLEILQDGLSILVDMCPKKPPTRGVFAPRKINKRIRESHNEIKQLRTQCDALLQQQHPYANITTTTAPNTGIPLPDPTTEQDAENPPPQQPPPAHDATTTAEPQRRPRPPPATPAIANLIDKIKRAGDTLRQILKKQTQHDIQKARDRFQHKLATRAKQAHKDIFSTQEQSRGIPALIHPQNKAHCTDKASILDAIHAYFQGQGASITGPRSGKYKPEDRTQVYPFDPSLKNSAPDTFTLHSATTPPTHALLPSIADSTNFDSCIDHLSRNKSPGPDGIPNELLRALPQTLRTTLHNLLTLMWVRAHTPASWTASETVLLPKPGDPLLLKNYRPIALANTTYKLWTSLITVAISDISHDLDLFSETQEGFLRYRNTERQTLNLVHALEDAGLTKQDIYVMYADFSSAFNTISHDRLLEIMWDLGMPHDLIRVVQNLYSNARTYIRSEHGLTAPIYIERGTVQGDTLSPVLFLVFIEPLIRWLHVGGRGYSYGCLPPHLNARYNCSSAAYADDLAVLTNTLSDLRIQCDKIHRYSEWAGLQVNHAKCRVTGILHRRAMQDKGLNGPTCNRTLRSMLENKIHIGTTSIPYLPATEPFKYLGVQVTMTLNWGPQFAYLCKNITDKSLSLQTCQASPEQCLRIIKSCIQSVAAYSFAVMPYTENDIRTLDNMIARLARTCYRLSRGFPTRAVLTPAEMSGLGVGSLLPIYVQKATRALTLALNDPGRLGMVTHALLELQTRIAGTTDMHKLRHESHYYTTLKQLSIMRAYNLTLWDHGAPYKGPPNTLLTAISRSPHPISHHLVLTLTQAGLDLRNLVGKERTPEGRACLIPSDILFQHLPRNQCQHKHRVALNRLSLCLSAECDGAREAPFNQAESYKCHLPLPQRYRALPNTPAFAALLPRNATPGELTTQSTMDAHLQHMTALHPNTEAQTPQHPNGLGPRQRQTTLAHMLRTTGAPPTAPTQSPTATLTQTPTGTLPTPPLAQPMPPPLTQPTPPLTTPAGPDAPNTQTPPTVASLTTAHQQPKSKKQRPNAIKRLQQKIDADPRHDPLPPTDMRSHTEKSGFILNNDPDENDSGPPNFVMWAPHYFANVQKDMQGTNRMPRLGIPRHHSRFPQNRTRPNPTRTIPAHLADPYFLGSQVDDTNPLNPVTAYISANPPTTPPTCAYDSRPRWADTGDFMIAPEPPNWPNITGATPGDSHDPRQADHDPQGQMRAEYMQERERLRAHLDDHPPQPRPFKRWMGIRLQLLTGKLPWPTQAYHVAQAAKQLVYSLYHDIEEISHIQAGPITKAVTAPEKGASLHTERYYEVAWKDTTIVKGAAEAYTRMKYTGTAAAHMGYGQACHKYFLRMKWDPTSEPVDKCPTLQGWTPAISEHLRKLAEPPTPTPQPKPKDARLTPAQQQGRWTQADVAASHVRRTTKQNTRIDTNPCNPYLDVHPTGRYTIQIPDTYTDERTLAHVYNPTGRHIASVTLGTLLTLKARYEHALSTHHDATSPHRSQGGFPEDLAKLLLRTRVDSKGKTCKSAPARERSLPESLKLALYNCLASTHSDPDRPVGLVERFASPLNCSGRATKYYSQHAADSLFGASHDAYTAPFDGLSLAHPDPDPDACTKALAWATASIEHLEHQATPAITFMIIPQGKGAASRCLASPHVTILALIPPGVSASSMLDGLGAADEAASSKQGLQLLLIANTTGVQALNSNNNLTRLQTSLAELGAVPPPTSQPPGRRQPLEWPARVTLPRDRTAPPGRPYSHRAKARAKQLTRPQAPAARGLDTCPTPMPTLSALYTTRAAFPTRSSYLYDAATIVWTDGSCIKVAAGEDGNEMNKLGACAWSQQTEHIYVEPGGLNSTNTIQRAELSAILVALEYIRPRLCLLGMTQVTIASDSLVSLYLIRRALTAPQRLLLSKHKNLLENILHELQMYADAGVPVQLLKVRSHTGLHGNEEADKGAAKVAANDMEAMGQAIRLAPDEPWSNIWWPKRNSDNFYLSDLNRGVLNSLPPEAQQGFTNNTPVLEQWAEASANMCPTLSNRTLASSTRHPWLVKQILYARYGYLFNAQLKRRYRLGGNGNCPLCHTPDSGGHILGGCTHPKMKGAYINRHNWAVQRVAKCISKGTYGNGFMVMDAGPLADLPHYASAQRPPAWLAAERTSSPLITRLRPDILFIPNLPAHETHREGYRPPLNKARLPIYILEIGYSSDVRHLDKREEKSQQHQELKRLLEAAGWTVHYSTNECLALGVTGAIPCNLTKLLTSQLGVTHTAARVCGERLHTHAVNSAGGIIKMRRVTEQELKPRGG

SEQ ID NO: 2862 - protein, 719 aa, synthetic construct
  source 1..719: note = Description of Artificial Sequence: Synthetic polypeptide
  VARIANT 7: note = Any amino acid
  VARIANT 14: note = Any amino acid
RFFEAEXFLSDLYXNFCNLLSHKPPEYSGDCLLQNFFSVFSEIVDKHAPLRSISRKKRRLLSKPWITKGLLQSIKNKNSMFSSIVKNKPNLQKYSVFKVYRNKLNHLLEISKQMYYKHEFSRSKNDIGRSWKLIRELIQIKSPTMTISKSVGITASDVTSDPINVANKFNDFFVDIGKNLASKIKPPTNHVPLKPFRKSSSFFISPSTPDEVFSLINCLDVKKGTRHEDIPTKFIKLANSIISPILSEIFNTCVKQGIYPDFLKNAEVIPIFKNGSDNLCTNYRPISLLSQFSKIFEKLLYNRLIKYLDKHKLLSNHQYGFRENCSTTLAVADITNMLLSNTDKGLYSCGIFIDLSKAFDTVDHSKLLAKLEHCYGIRGVALDLFKNYLTNRSQYTFVHNVRSSIKPVLCGVPQGSTLGPLLFLMYINDLPLVSNFVTKLFADDTFLCMSSKCPYELQAKVNLELIAIDDWLRSNKLSLNYSKTSYVLFTGNLKPIGINDFHLNINNNKIIRSQSAKYLGVLLDEKLNWNCHILNLSQKLARYCGIMFKLRKYVDIKTLLNIYYSLVYSQIQYAIVCWGASNKKTLYPLNVIHNKIIRAMSYSPARCHVTPLFSDLKILKLCDIYKLEMGKLMYKFHNKTLPDSFNYIFQPLYCAHNHITRQVAHHDYFVPYFHTLLGQNSIGYRGPVAWTAIDVSLKKLGWFSFKKQLKNQYLLTYIT

SEQ ID NO: 2863 - protein, 31 aa, Gammaretrovirus sp.
HIHGEIYRRRGLLTSEGREIKNKSEILALLK

SEQ ID NO: 2864 - protein, 801 aa, synthetic construct
  source 1..801: note = Description of Artificial Sequence: Synthetic polypeptide
MAQRRFLLKCRYARVFPNHIKHLYNKCSSVNFRCKPIHADFNKSTLHFCQKLLNFEISDINTHIRFLQNSISRLKDHIASLKLDYNIRERHYKFVNIKQNTIYRRSNHTLHKKFKKILPKTNTTTSNNDSIHNLTNIAIPKDVAEIASLGPNFNLPSTFRERDFLCIIKNLEVGLSHLDTNDRVKTEIRDKVSQYLVNACKQKPAISRKDRQYAKNLKSTKNFLNKNPDIFFTSADKGNVTVCLKKSDYTERMHNLLSDKSTYKIISKNPLNSLQKRTSNILKNLNSNGFLSRTYHPNALSLTDTTLAKCYGLPKIHKVDAPLRPIVSLINSPTYFLAKVIYDELKKSVNVPISHINNSFELKNKLKNIKPTTNYRLMSLDVSSLFTNIPLELVLRSIDRRIVTIMNKCRIPVDEIRQCTEFLFNNTFFTFDNIFYQQIFGTPMGSPISPLFADLVMDDLENDCLSILKNNYNIIPSFYFRYVDDVLLFINVDHIDQILNIFNSYHPKLQFTYEMEIDKKLNFLDLTIIRNSNYFNFDWFEKPTSSGRILNYFSGHPVSYKRNIVFNLVDRAILLASTRFHGVNIARVKNLLIKNNYPFNFINKNIKVRLKRHKYSNHNRSTTNTYPLCKIGIPYIDNNFEKISTMLKPYNIHTYPLINNKLQHIVRLGKDTTNKHKQTNVVYKFYCKNCPASYVGETKRAAEVRISEHMKSKNSDSVVCAHQINFDHEFDWDNFKILDKESNYKKRIISEMLYIKLDKHNINRKEDVLSFNRAYLPLLRKFKCPDRVHRPLPSTFAAPPI

SEQ ID NO: 2865 - protein, 403 aa, synthetic construct
  source 1..403: note = Description of Artificial Sequence: Synthetic polypeptide
LFNNICFDAVKMAIEKFWHHIHNKINLSLTDFLNVIEFIMNNNYFQFNNNFYLQRRGSAMGSPISPVLADIVMRDLETACLNLCPFNIPVYFRYVDDILLCVPVDKVEYVLNVFNSYSHFLNFTIEKSENNTINFLDMTIVANNDSSISTNWFRKDTHSGSYLNFYSHCPISQKKAIVSHLVDKNYKLSSPEYFSNNFKYIYTVLLANNYPLDFIESCIKKRLYFLKSINNSQNNISPVNNAIGSLVIPYCRELDYKLRVFCSKSFINVIFKSSNKLPFNRMYGKDILKKLNNPNVVYKIDCSDCSNCYIGQTLRKLSIRLNEHKSDIKHKREKSALYQHHLDTGHSFNFSDNEINIIDIEQNYYKRLLSEMIFIEKTNNFNRMLDCDNLNKVFKRYIHLLLK

SEQ ID NO: 2866 - protein, 752 aa, synthetic construct
  source 1..752: note = Description of Artificial Sequence: Synthetic polypeptide
SDINIYKNYLQKELDKIEKSLIFTLGIRFFELFERFFHYKSKIGIKTFDDILTNKFKILYFRKYKHTYEKKININNNSIRVSKTNSNIKSKWLHNLTTINLPKEVQFCINLGKNFNFFDFENQNETKRVYLELFKSLNKPLHKNQSISNNIKFKILDLVKTHIKNNNKSSLDILISNMLNNCNKFLKNNKNIMITKSDKGGAFVIIDKQDYINKVEESLNDKKLYEVVEHNPLPSLINKTSNLLNELNGSDLFGDSGNKKVFNTIRDKCILAKCYGLVKVHKPNQPMRLIISNIGSPTYFLSKWVSEFLKNNLPPSPHNVKNSFELKNDIKNFLIPDGFCIVSFDVVALFNNIHFESVKVALESVWHILNLKINLEFFSFLNIIRFIMENNYFSFNNKNYRQKFGSAMGSPCSPSLADIVMRHIIKMLLFLGPFEIKLIKVYVDDLLACIKISESDKVLNYLNSIDKHIQFTMETPNNNSINYLDMTLTWDNNGSIKTNWFQKPTHANLHLNYWSHSPLSQKIGVIYSLVDRAIKLSDTCYHNNNLKKVYEILKENNYPPDFIKKHAERRKKIIYYNNKNDNNNNSNKKLNDDNKNYIVLPYIKNCDSNFKSLLNKVSYKTIFKSVNKQKFLNQLGKDSIKNKDKVCSVYCIKCKNCDKCYVGQSSRVVSKRINEHKRDVKSKKNESAIFNHVQDNGHSFDFDNFKVIDNEPNFYKRLISEMVFIKKYNTVNKVTDTQSLSSVFEFYINKYL

SEQ ID NO: 2867 - protein, 646 aa, synthetic construct
  source 1..646: note = Description of Artificial Sequence: Synthetic polypeptide
  VARIANT 596: note = Any amino acid
LLKPLEAALAVNKKIEVDTSKKIRQTYLQVIKKNIFNSKKISYFDKTINNHLNETKMFLKEHREILVTRADKGGATVVINKTDYINKVERALGDSMYYHRLDSQKRANHLTRIINSTKKLVDVWDNRGVFDTVEIDRPDVNQLSGCNLAKAYGLIKVHKPGLPVRIIVSAIGSPTYTLDKWFSKFFNKFCKRSPSSLKNSYDLKSTLRDLIVPHNYLLVSFDVVSLYSNLPFSLIKKSVEEKIGRTLDSMHLDRKEFLDGLDFLINSNYFTFNNHTYKQTCGTPMGGCTSPWIAEIVLESLEKSVLPRCRDSCLMYRRYVDDCLLIIQSDSVDTVLGIFNDFNPFIQFTVEREDNGVIPFLDVTITRIADSVCEIDLYSKPSSSGRLLNFFSHNPVSQKIAIVFSLIDKCFKLADPKFRSRNIDRARRALTMNGYPTYFIEKYIKARISIINRFNKNKNHINSLTNCEMSPPVMEGSSRLSFIILPFYPRLEKTLRSFFSKHKLKTIFQNSNKFTNIIRLGKDQTPKLKRSGIVYRIECECGLFYVGQSKRRLATRIDEHKRMVHKCDKNSVIAAHCSEFSHTFKFDEVKILDQEXNKFKREFSEMLYISYFNRNVNRKLDTNKLHDHYKSFLYELRDRMHGWRCS

SEQ ID NO: 2868 - protein, 671 aa, synthetic construct
  source 1..671: note = Description of Artificial Sequence: Synthetic polypeptide
  VARIANT 569: note = Any amino acid
  VARIANT 574: note = Any amino acid
MDNPTYSPNETLNRNFLFDEINRLVFKTKSKSASGYDEIPYGVLKSQKVIETLTRLFQLILDTSIVPSVWRKAIICPILKDASTDPRIPMNYRGVSLLSCISKIYSAFINQRITSHLDAHEYLMSKTVSEKTGRVKTRIHLNSVIRIKITIRSFHDLRKCFDFIDREMMLYKLLVHDIDGKVYNSVKSIYQNSESCVRWQSVQLCEKYLPKLRIVCALNGQLTNSCNTGVKQGDNRSPTLFSIFINDLVQDINELGLGVDVGEKKLSLLLYADDIAMIAKSKAELQRMLDKLHQWCKRWRVLINTNKYKCVHFRKGKIKRSNCNFTIGSNALETVDHYKYLGVTFNYNSCFNSNAELLAKLLAKSGGRALGQIIAKIHNNKYFGFTSYEKLFSSCVAPILDYGAGVWGYRKFQAIDNIQNRAIRYFLGVHRFTPILFLYGDVGWLPSQFRRWFCMLRYWNKLICFEDDRITKMAFNLDYERCRDNWCSEVKHIMNQIGIGQYYDTKCAIDLGLVESHLTNFYSEIWKDSLENVPKLRTYKTFKTDFGLENYISFNLSKAERSHMAQLRXGILHXRDPPLRIESGRYVGEPPNERLCTLCTQQVIENELHFVLDCPFYNQYRTEILGEQLLSPALLNRDRQYVFTYLMSHKFRQLSKFVVKAFRIRRQFLYR

SEQ ID NO: 2869 - protein, 1137 aa, synthetic construct
  source 1..1137: note = Description of Artificial Sequence: Synthetic polypeptide
MGNSLEQYRAAIGNFYFSCRCVCRSVLVNFFGFSFFSKIFMFPSIGLFALAMKHLSRHIVVYNFYLQFFMFLLLLCGDIEVNPGPIMTNVLDILHLNIRSIRNKVANLNTIVHDFDILCFTETHLDRNVTNESLMLDGFNTIYRKDRNCFGGGIMIYLSDLLRAIRRPEFETTCNESIWIEIESHTCSYFLCCVYRPPNSDGNFWTSLSWSIEKVGEITDNIIIIGDLNVDLLSIPQTHVIHDIMSNGNFVNNINEPTRVTNTSSTLIDLVLSTPAVKVHESGVLNIDSSVSDHKAIYISFSIDIELNRAYERNIWVYKDADFEKLNSLISNCDWDITINSAPNIDAAVAQFTSTFMAYVRECVPEKTITIRPRDKPWYDSMLRKTMRIRDRLRNKALRTNNDADWTKFRHVRNKVNNMKKHAITNYYDNIESALHDSSRNGKIYWKLMKDLFKVKATTEIPPLQFFENGQPTLAFSDIEKTETLNKYFSSISNIESANRSLPNLYYMCNNFFSDIHIEVQEVFDIISILPVNKAIGPDNISHRMLKYTKFSISKPLCMLFNKSLVENSFPNYWKIAHVLPLFKKDDPSVASNYRPVSLLSCVSKIMERIIFKHVYNFFHENNLFYKYQAGFLPGHSTVFQLLETYHSIVKSIEDGKMCCMIFCDLSKAFDRVWHEALIFKLQTYGISGHLLQWFKSYLSDRTQRVMYKNKLSSTLCINAGVPQGSVLGPLLFLIYINDVATNMLSFCRLYADDNSLQHCDLYTKNIEIVLNHDLKILSDWSDKWLLKFNPSKTKAVFFTKKHVEEFPKLFFQGCQLDYVSTHRHLGLLFSNDLSWSQYINNIVNSAYKKLGLLKKLKFTLGRTNLSKMYITFIRPVLEYASVVWDGCNMFDMERLEKVQLSAARIVTGLPILASTDSLYTETGWESLVSRRNKAKLITMFKIHTNQVPEYLSNIIPPVTKNVSIYHTRNSENYSVPISRLELYKKSFVPDTIRKWNSLKLEVREATSLNIFKKNITESIPQPPKYFSFGKRTINILHTKLRHNCILNYDLYRRNIIESPNCICGQKEDVYHFFFVCKNYVNARNNLFELLFNRLDETILINSHLLLWGSDNLSYNTNCFIFSAVQKFINESGRFNN

SEQ ID NO: 2870 - protein, 1053 aa, synthetic construct
  source 1..1053: note = Description of Artificial Sequence: Synthetic polypeptide
  VARIANT 14: note = Any amino acid
  VARIANT 31: note = Any amino acid
  VARIANT 43: note = Any amino acid
  VARIANT 48: note = Any amino acid
  VARIANT 69: note = Any amino acid
  VARIANT 70: note = Any amino acid
  VARIANT 75: note = Any amino acid
  VARIANT 86: note = Any amino acid
  VARIANT 442: note = Any amino acid
TYFCSRMLYTPESXVFYKKGKVDIFDCLEEXYCSFHRKGHIYXVGDFXARCGTLDDFISDDKLGKSVEXXLQSFXDYDNNANVYCXHNADRGVNNFGKKLINLCRTTGLKIVNGRNENDYNGNITFYNANGTSTIDYLLTDVYNFDNIAYFSTGIFNCFSDHAPVSFCIKTNYIDGGSKALCCANTSQGNGSINQCTSVRWKEGADLEATWSISEHYDLFLSYVENQLYTQEDVDNCVANFSKTLCKIMKPYCIITGGLANTVIDAERCIDKPWFNDICKSKYRDYRGALHNFNVCKSDVNRIVLCAKKKVYKKNSPEVIELYFVQRKRFIKKTVQKFKHNYERYQGDRMEYLRKCNPKQFFRLFKNNKKISCDVSAKEFFEHFKNLFENVKTTTYDNTSDDYEILPCYEELDVCISELEVEKAILKLKSNKSNAEDGVINXFFSKCKEVMIPILCRLFNNIFDSGFYPDNWSKGCIVPIFKKGEMQDLNNYRGITLVSCLAKLFTSIINTRLLEWDQRYNIITDAQFGFKPGVGTIDAIFVLQNLISRTLKNKKRLYCCFVDYTKAFDLIDRSKLWYKLQMEGFGGKLLRIIKSLYKNVRACVKHKGTFTETFRISAGVLQGEILSPLLFSMYLNDFERYFINSNCTSIELQMINMFLIMYADDTVLLAESPEGLQDMLNTLHRYTDEWNLSVNVQKTKIVIFRNGKCVKDNEKWEYNSKYVEVVNQFNYLGMLFNYNGKFLSTQKHCAAQGNKAMFSISSKMKDLNFNVETQLNVFDTYVKSVLSYGAEIWGFHKGQDVEKVHINFCKKVLGVRKNTCNSAVYYEVGRFPLEIFRKQKIFKYWFKLRNSKNCILKACYEDMVKNNDIWISNIRKELSILGLADLYQSTMKESVILDIIFNRMCDVFKQKVVNDISNASKCILYKHVVDHFCLQVYLKKPIHVKYRKLITRLRLSSHDLKIETGRYDNLTRDCRKCESCNLNVIEDEFHFLLICPSLCSLRDKYIKKYYSRKPSVYKVIQLLSTSNTKELCNLGKYLYYANKQRTLHVNYPN

SEQ ID NO: 2871 - protein, 531 aa, synthetic construct
  source 1..531: note = Description of Artificial Sequence: Synthetic polypeptide
  VARIANT 89: note = Any amino acid
  VARIANT 298: note = Any amino acid
SHPERIVFKHLYNYFHSNNMFYKYQAGFLPGHSTVFQLLETYDDIVRRIDEGKSCCMVFCDLSKAFDRVWHKGLLYKLKMYGIDGKMYXWLKSYLANRTQRVMYKNLFSTKAQIHAGVPQGSVLGPLLFLIYVNDVAHNMSSFCRLFADDNCLQYSSKCVKTIENCLNHDLNVLENWSKKWLLKFNPSKTKVIFFNTRKNLEPPKLIFQDSQLEYVQTHKHLGVTFSSNLSWSSHIEILLSNAYKKIGLLKKLKFKANRKTLSLMYTSFIRPQLEYASVVWGGCHAFDSEKLEKLQLXAARIVTGLTIFASRESLYFETGWEPLNARRKIQRLNIMYKIHNNLVPEYLSDIVPDMRCNASAYYTRNSQNYNIPVCRLQIYKSSFVPTVVNEWNSLPLDIRDSSSLSLFKNKISKSLAVAPPYFSYGKRRTNILHTRLRQNCALNIDLYRCNIISSPLCSCGKIEDAHHFFFSCPKYATVREEFFNKFLRFGKIRILDSRSLLWGDDSLSVDENKYLFSIVQIYIQGTGRFE

SEQ ID NO: 2872 - protein, 538 aa, synthetic construct
  source 1..538: note = Description of Artificial Sequence: Synthetic polypeptide
MKGPKFREPRSFTWRRNFIHIMNSVEDYAKRWAKSEKEELDTLSEWVKSIRCILKSRIKRLRGQMKTIYPSVFNKAEVRKELDRLHDQYVLVPADKASNNIVFVCKAHYINCIFKELGFDSTHGNPTYTHSSLSKQEILQNHKSVMDIFNIPNTQNEFDLPYLYWIPKLHKSPYKQRYIAGSSKCSTKPLSLLLTKILTVVKEKLQEYCTTIYSRSGVNQMWILKNSKELLETLRSQNLTKINSIKTYDFSTLYTTIPHDKLKSRLFDIIDSCFFNKNGSRKNAYLVIGNLKNYFVKNHSDCTHKYSEVDIKKMLEFLIDNIYVVFGNQVFQQSVGIPMGTNCAPLLADLFLYSYEAEFIQKLVREKNKSLAVAFNSTFRYIDDVLSINNCYFHTYVDSIYPSELEIKDTTESASSVSYLDILLEMDIDGNLTTKLYDKRDDFNFSIVNFPYLCSNIPSSPAYGVFVSQLIRYARACSSYEQFLRRGKLLTNKLIKQDYQQSRLKSSFRKFYGRYNDLVSKYNLPLGRMLTDVFHTNC

SEQ ID NO: 2873 - protein, 1416 aa, synthetic construct
  source 1..1416: note = Description of Artificial Sequence: Synthetic polypeptide
  VARIANT 30: note = Any amino acid
  VARIANT 42: note = Any amino acid
  VARIANT 49: note = Any amino acid
  VARIANT 1400: note = Ile or Leu
RAILTLSCPFIKIKSTHCHRPLTLLWNDLXWLRMGIARFMKXVSVGLYXIPWKTQISQLLQQIKFEPSEDILSVAKELVAHLDDSAQVVAAARLKNRKIDKPGLVKISFARVDQKIRVLRAKRKLGEISDYRSVFLRSSKSHTERLIELNARTILNEMPNGKDFRITANGRIVKKTDNEPNTRDESSSELPRPFETIRIGHLNVCGWTNKNHDLRVEIIKYTDCDIVSINETHLLNKENLDLDGYQWMGLNRSNVHVKAPKGSGGVGLFIKKHLCKNYKVDIIDNSFDGILGVKFTNKFSDYVFVVFSCYLPPESSPWGRDASSFFSHLLTQIYIQYDTDSIFICGDFNARISNIPDFDKDLDTIPPRLTIDNVHNQHGSSFLEFLNDCKFCVLNGRFGNKSNDYTFQSTRGHSVVDYICVPHDVYNSVLRLSNNFLMEDLAINQMTIHFNRQEVIPWLTIYVFLMMFTIQCSDFQIISCSDIVENAGLVSMQGENCRIPDHGFLIFDFMIRDFENAHPSENTVTSSTRPIKKYKLRCIPPSFMSSVNVRGSLLNMIRIIETCRESRENIDRTYTQLCNIITKEMECSIPKFDWSKRSRKKFRTHKPYWNNELTELWRVMREKEKTFLKHKKGNSVLKQKSFSEYKRAQQELDKRMRFFRRKYNLDLAINLDNFSSNNPKKFWEELRSLGPKRKNKVPTECYTDDNDGSISSDPTYVQNVWKSEFCNLYNPSTDVAQQPSNDAFLQRVKESVNFMENNMLDPLREHNPYLNRPIELDEVKNVIMKSKNGKSSGVDEIPYEVLKYDCVIEVIHRLFMLCFESHIIPSVWRQAIICPILKDSNSDPRVPLNYRGISLLSTIYKMYSSILNHRLVSYLEDNNLLVDEQNGFRRERSCADHVFTLNSIIQNRKETFVAFIDLQKAFDTVDRDLLKFSLLNNGIDGDFYNSIKSIYGNTVSCVRVSELCTDWFSTSAGVRQGDNLSPTLFALFINDLAKEIKELRKGITVGEINLGILLYADDIAILSDSKENLQKILDTVSYWCEKWRLHINMKKSGIIHFRKKGPRSDFQFQINSNILQYNTDYKYLGVIFHEKMNFQNNADTLSKAGGRALGGMISKIRSIFPKFGPYKEIGISTFEKLFLNCVAPVLDYCSEVWGLQNYHSIEMVQNRALRFYLGVHRFTPLPALHGEFGWKLCYHRHCINAVRLWNRLLTMEDDRLTKRVFLWDFNQTGLSRWTSRIKSLFESMNLLHIYDNLSICDVNEFENKLFLTYENEWLGKINQLPKLRLYKSIKTNFKTENYLEMNISKSQRSILAQFRCGILPIRIETGRYKGEPLDERICNFCVLNEIEDESHFLLNCTIYSDFRRELFNNIGYNPTLVMSNLDCIFFLLSNFPRQTSKYLXESYLYRQSLLYKKRNA

SEQ ID NO: 2874 - protein, 1521 aa, synthetic construct
  source 1..1521: note = Description of Artificial Sequence: Synthetic polypeptide
MNLSSPSPSKPPKKKKQRTKSSTQGKMATTQQGACTNSVYPNDNLSQSVQPIQQVGNLTYHQLQPMQYIQSAHAPMQTHMQHQPQNVQSNTPQVTPQWVSDIVTQLKNMNQKLDTIDTTLSSMKREIKGLSNRVVEVEKSQEFISKSLEDNEKNTSKALTELSDLKMALDQSLQENVRITESVLDMQCRSMRDNLLFFGIEEAQSGEQENCEDIITSLCASKLEIRSEILIERAHRLGSKKNNKPRPIVVKFNRFPHREMVRKCSYKLKDTHISIGEQFPKEIQERRKKLLPIYKRAKENNQKAVLARDKLFIDGKLYSDDGPVQMKATPTQPKASGRRGQKHGRGKRGQENQTGLRIIAWNIHGGLENKWSERNFKSFLCTYDIICLSECWIGKDFNISDQNFQSFVFPRKSGKSQGGGTVVLIRNVYTPFISFVESLHDTIVWLKIDKSFCNHTKDIYIAFTYFPPSNSTFLKERDIDLFMELENQLSYYMSIGDIFLFGDFNSRTKTLPDYIVNDQVHESVLDNNLQYSSDNQLTERVNPDLGHNEYGQRLLSLCRSTGVRIVNGRHSGGHSNDYTFNGARGLSTIDYLLTTYDMFDFISKFIVCNFTTFSDHAPLHIEFKCTTLLDPCDTSSHYRTRNVFRWDSSYVDSCNDFFNSIEGTCNFVDFEKVTSQSDLDECMLKITDMLSKDIGNFFYVSSKNSNQSKPANSRSRYSTYLSTNDKPWFNENLKSLYRDYITALRTFNVCKNAQNHLNLVSKKRTYKKLEAKLKRSYKQIEGNRLNILKKNNPRQFFAKFRKKPKSVGNVPIEIFFDHFKKITNVDGSFDTNCEQANMEVLIPIVNKPTDECVFYELDKEIDVDEIRKAISNLKRGKSHGEDGILNEYFINFQQHLLPLLYSLFNCILDTGFFPKSWSSSIIVPVYKKGDCTNPDNYRGISLVSNMAKLFTSILNNRLLDWSKTNDVITDAQFGFKPNCGTRDAIFALHSIVTNTLCKRKRLYCAFIDFKKAFDSIDRSKLWLKLSKVGIQGKLLNVIKALYNDVKSCVVVNGHLSDYFCNNVGLMQGEVLSPILFNLYVNDFEMNFLKSGCIPHELLSLNLFLLMYADDMVLFSESVEGLQLLLNELSHYCKTWNLCINVEKSKIVVFRNKGKIKCNEKWCIGNDVLEIVEQFTYLGIIFQYNTKFTKAEKQLSDQGRKAMFAFRKNIRGMILNHETLLSLFDCYVGGIINYASEIWGSHKGNNVEKLHLDFCKQTLGVKRSSFNAAVYAELGRNTSYYKKVLFNFKILEGCVMVGIPLITKRFCSILKFWKDVLCSNNCIIQKCYEEMYINCELHGHKNWASDVKKILNEIGFNEVWNKQTIDSLTLKVINQRIADLAKQDIFGKIENSQKCHFYKYLVDGFYLQYYLRKSVPVKFQQCISKLRLSSHRLAIETGRYNNTHRAQRNCFSCKNYVEDEFHFILVCPVYIEYRQKYIKKYFYEKPSMFKLLQLFNNENFKDMCNLGKYIYYSMKLRNDICN

SEQ ID NO: 2875 - protein, 1268 aa, synthetic construct
  source 1..1268: note = Description of Artificial Sequence: Synthetic polypeptide
MDDKVQQSYLSILTLNCQGLGDINKRRDIFKVLKSKNYNIYFLQDTHFVEKEESLIKGLWGYKAYFNSYKSNSRGVAILINNNCDITILNEHKDSDGNFLLLDVTIESLPFLLINIYGPNSDSPAFYINVLNKIQDIYSNQHIVIGGDFNLVFDKDLDSMNYKNLNNPKARLEVLKIMETLTLKDVYREHNPTLKKFTWRKKNPIKQARLDFFLISESLLNLSLYVKYENSYRSDHCPVVLYVRTNEFLKGKGFWKFNNSLLKDKEYVYLIKEKIKNVKQQYACPVYNLENIETIDDNIQFIISDQSFLDTLLMEIRGKSISYSTYKKKKTTEREKQLEQEILLLEQNFTVETKDELSNKQTELELIRKNRLQGQCIRSKVKWIEEGEKPSKYFISLESRNFSSKIIPKVEKEDGSTVFNQFEILNELRMFYDNLYQKRETIDSENIYEKLKLYDIPKLNKQESDLLEGPLNKLEVYNFLKNMKNDKSPGPDGFTSEFFKFFWNDLGSFITRAINNTYELGHFTESNKLGVITCLPKAGKPKQFLKNWRPISLLNVLYKIASGCIANRIKTVLYKLINEDQTGFLKGRFIGENIRMIYDIMQYTEQNQIPGLLMLIDFEKAFDTISWKFIYQTLDFFNFGISIKNWIQTFYSDIKSCVIQNGIASDYFFPQRGCRQGDPISPYLFLLCAEVLGILIRNNKEIRGIEIDGVEYKLSQYADDTSIIFDGSPQSMDGILRELDYFACISGLKINFSKTKMVWIGSKKISKEVFHHSRWKLDWNNPTFDLLGVKFSVNLNEMVELNYPSKFLEVTRLIKQWKLRNLTTVGRLTVIKTLIIPKLNHLILTIPKPSVEYLQQFEKEIYIFLWGGKVHKVKKNIIIQDYRYGGLKMIDYMEFVCALKSTWIRRLIHSNTKWVKLFESELGLKIETLWEKGSDFITNISNKISNKFWKEVLLDWVKIVMSYSQNDIKVLNEHIWFNPNIKINNSSIFIKNYFNCGYKFIKDLMTEEGNFVSLETLENSNVKTNFLEYRSLKGAVFERLKALNNNKVEYGPFIPNSLSIFYKQSKGCKDMYYVLIDNKKESIRSVKKWTESGFAYTEIEWNNIFELPFKTSKESKFQWLQFQILHRILPTNEYLFKLNIIDSPACSFCNQDIETIEHLFVDCFHVKEIWLYFEEWLRSKFNFLMTFDKKTILFGKFKNRNMYRLQNILILTVKQFIFASKYKNVPNLSTLMLKRTVTDRIHIEKLLLLKNCKFAEYEKYWQTICDLL

SEQ ID NO: 2876 - protein, 441 aa, synthetic construct
  source 1..441: note = Description of Artificial Sequence: Synthetic polypeptide
  VARIANT 31: note = Any amino acid
KQSRVLQGDILSPMLFSLFLEDLETHLHENXSAGIEIDQINIFLLLFADDLAIISETPNGLQKHLNTLHTYCERWGLTVNIDKTKVMIFQKGRTRKGYKFCYNNKNLEIVDSFAYLGTVLSPNGLFNKHVKITAEKTLQLYNTFMYKTQKLSLDCKTMMELFDVACSSKMNYGAEVWGYTNAKDLERVHLKFCKRLLGVKTSACTPAVYCELGRKPLLLTRTLRIIKYWFKVLRSQNCLMKSIYDYDLKNMLSSWIIFVKNTLLSNGFGDVWYYPESVNEKMFYVYFEQRLSDCFYQNLRVEIENAHPLRLYKYLNLPVHQAEYLNHILYDKHRKALSRLRLSSHRLRIESGRYDKKCPINERKCIYCKSNDVEDEYHFVLVCDFYTELRKLYIKKYFYVRPSMAKFIDLLNSDSIFMLKKLGKYVYESFNKRDNFTIRRE

SEQ ID NO: 2877 - protein, 1096 aa, synthetic construct
  source 1..1096: note = Description of Artificial Sequence: Synthetic polypeptide
MKNRHKLSNRRSGGLILAFKDTIVKYIKVLETDCKFIFLFKLSKTLLNISEDAVCGLVYIPPEGSRYSSPDCFSEIEQEIINVESNCKYLCLFGDFNARVGKMQDYYTPDDFLAHVTHCEIQSEVATRSIIFDNYQIPLDRIVRDHTINNFGYKLVEFCKNNDIYIMNSRVGNDKNIGGTTCKDSSTVDYVLASANFFAIVESFNIKNFCDLFSDVHNPISFSFSICINDAKNNIPGKNQPSVKLWCADKADDFRNNIQMSAVCEIENELNVLSSCIDNICKDNISKIAKDICTVFVNTARETFGMSKHVDNFSNEKSSKPWFNRVCRTARRKYHLAKRLYNRNNSTDNKENLKVLSKQYKRTMDGCIKDYKKTITKKLVNLRSTNPKDYWKILHGSRRDEKCAVSIDDMFQFLKDMNEGCENGESNIDNPDFIGTCMYDDILNGEISDEEIVAAVKKLKNSKAAGYDLIVNEHISSTLSIFLPVYKKFFNIIFCSGFVPDEWLIGIIKPIYKNKGDPTQPENYRPISLLSCLGKLFTSILANRLEAYATETNLIYENQAGFRKNYSTLDHILTLQFLCDIFMKRKKKLFCAFIDFKQAFDTVWRTGLWSKLILNGINGKCFRYIKNMYMGIKSLVKLNGIASNFFECNVGVRQGENLSPFLFSLYINDLENFLLEKNIVGLQSISNEIENELLLHLKLLILFYADDTVIMAESTEDLQNALNEFYSYCTQWKLNVNVNKTKIMVFSKGPTSKKLFYYKGEVIENVKEFKYLGIVLSRTGSFIKARKHLCEQAQKAMYGVIRKIRNFNLPVNCQFDLFDKVVLPVLLYGCEIWGFENLDIIERVHLKFLKTVLNLRSTTPNFMIYGETGRYPLYINVYTRIITYWGKMLISPENKIVYTVYRYLFSQHFNSDCKSPWIDCIQRILNMCGLQYVWQNHNFVNIEWLSATVNQRLKDQFMQIWSNDINCSSRGQVYKILKPYFGFEKYLDILPVKLRKKFIKFRTSNHRFPVETGRWYNIPLNERLCLLCNKGLIGDEFHYILECSALEEIRKKYINTKYWKRPNFFKFSELMTNCNCKSLRKLCVFISKIFDAVCSS

SEQ ID NO: 2878 - protein, 1164 aa, synthetic construct
  source 1..1164: note = Description of Artificial Sequence: Synthetic polypeptide
  VARIANT 36: note = Any amino acid
  VARIANT 366: note = Any amino acid
  VARIANT 996: note = Any amino acid
  VARIANT 1046: note = Any amino acid
  VARIANT 1096: note = Ile or Leu
MAGDTIEQYRAAIGLFYCCVRCVKKCFYLNLFQLRXLFKCLLQYLLWFGNLYKTLSMCLAQHSLVIDYFFQVIFMLLFLSGDIETNPGPCTGTQYTLDIFHLNIRSIRNKLDSLLSLVSDFDVLCFTESHLNSSIPDRNLFIDGFNTIFRKDRNSFGGGIIVYVSNSLRVKRRTDLEPTNIECIMGNQQTLNALWVEISDPTCNILLCCTYRPPNCDNSFWRNLSWSIEKAYDESDKIIVVGDLNVDFLNIPHTHLVKDLLSSHFLENTITEPTRVTQNTSTLIDPILVTRDVSFFDSGVLDVHHTISDHKATYIYVKSNLNLNSAYKRKVWLYKNADFDKLNFLITHTDWETLIMGADDVDQAAXNFSETFLSHIRKSVPEKTVTIRPKDKPWFDSALRKEIRQRNRLRKIAMNSRNALDMQKFKKSRNKVNNMKKYAIDNYYNNLEINLLDSSKNNSKLYWRLLKNVFDIKMSTEIPPLQFALKNGNQSIAYTNTEKAEVLNDYFSSISCLDDNDARLPEFNSECNNFICDVCISEQDVIDIISIIQVNKAVGPDNISHKMLKNTMYTIAKPLCSLFNRSLRDCTFPSSWKISNVLPLYKKGDSSQMSNYRPVSLLSCVSKIMERIIFRHVYNFFHDNNLFYKYQAGFLPGHSTVYQLIETYDHILRAIDQGQSCCMIFCDLSKAFDRVWHKGLLFKLHTYGITGNLFKWFNSYLVNRKQRVMYREVLSSIKSINAGVPQGSVLGPLLFLIYVNDIADNMLTFCRLFADDNSLQHAAINVHDMESYLNRDLLTLEVWSKKWLLNFNPSKTKAVYFSNKLTQTNTVTPTLKFQGCDLEFVPTHKHLGVIFSEDLSWSSYINSIIANAQKKLGLMKKLKFKLNRKSLSLLYTSFIRPQLEYASDVWGGCSINDSDKLEKIQLIAARIVTGLPIFASRESLYFETGWETLYSRRKISRLKTMYKIDRNLLPSYVMDIFPNKRANVSNYSTRNAHNYXIPKCRLELYKSSFVPTVVDEWNALSTDVRGSDSVRIFKEKIHVSVKNENXLTCRTRPNFFTYGDRFLNIIHTKLRHNCALNNDLFRCNIINSPLCSCGKXEDTYHYFFTCNKYKDARNVLFNDVFQIVNLNIVNTHVLLWGDSSISDNENKHLFTLVYNFIKNTERFN

SEQ ID NO: 2879 - protein, 390 aa, synthetic construct
  source 1..390: note = Description of Artificial Sequence: Synthetic polypeptide
CESALNLLLLKWKQCIEKGNIVLSVFVDLKRAFETIDRTKLIRVLKKSGIRGTVLKWFSSYLENRKQVTRYNDAVSAETAVDLGVPQGSVLGPLLFILYINDIKQALKRVQVNLFADDTVLFVVGDSFDECFDIMNEELGGFSEWLKWKKLQLNITKTKCMLVTTRQTKDCRRSVQMDGGIVERVETMKYLGVMLDEKLNFNEHIDYTIRKAARKFGVLCRINRYLTAETKVQLYNSLIAPHFDYCSSILFLATQRQMKRMQVLQSKIMRLILRCDRLTPRRSMLECLQWMSVKQRIEYNTLVFVFRVKERMAPQYLTEAMVRGRDIHEHDTRGADDLRLQIWRKACTQNSLFYKGFKLYNQLPEAAKMTSNINEFKRSCKEFVRQRPLE

SEQ ID NO: 2880 - protein, 701 aa, synthetic construct
  source 1..701: note = Description of Artificial Sequence: Synthetic polypeptide
  VARIANT 35: note = Any amino acid
  VARIANT 65: note = Any amino acid
  VARIANT 142: note = Any amino acid
  VARIANT 453: note = Any amino acid
  VARIANT 466: note = Any amino acid
  VARIANT 589: note = Any amino acid
RRADFESLSRALRGIEWSSVLDPVDIDLAVDTYTXILGRLIEQFVPKIRKVVSHHLPWQTQELRXLKTQKRAAFKVSNGSVHLRDYYLRINHSYQRLSRRCFANYQRKMQKKLKTDPKKFWKFVNESRRESGLPTSMRLADXEGDDADKICQLFAKKFAGVFCAEPITDEEVRAAAENVPRRDELLASIEIDEGTIQAAAAKLKHSCSPGPDGIPSTLLKRCSSSLSAPLLHLFRLSLSSGKFPVAWKQAYMFPVHKKGDRTNVENYRGISALCATSKLLELVVIDPVFSHCRQDLADEQHGFFPKRSTATNLLCFTESIINSFDAHSQTDAIYTDLSAAFDKINHRIAVAKLERLGFRGSLLAWFKSYLTGRSLRVRIGDALSDIIDATSGIAQGSHLGPVVFLFYFNDVNYTVTGPRLVYADDLKLFARIDNSNDAEALQRDLDRFAGWCXVNRMILNPGKCQXITFSRRHFPVTFDYRINDTSVERVTHVKDLGVILDTQLTFKQHLSYIIAKASRQLGLVIRMTRKFTDIYCLKTLYCSLVRSTLEYCSTVWSPHYNNAVCRLESIQRRFVRYALRQLPWTNPLXLPPYEQRCRLIDLDTLQLRRDLARAMTSADVLLGRIDCPDLRNQIQLRVPTRQLRHTPALEVPFRRTNYSANGAINGLKRAFNKVSSVFSLDVSRTTLRFKFVSLLRSLLRM

SEQ ID NO: 2881 - protein, 1378 aa, synthetic construct
  source 1..1378: note = Description of Artificial Sequence: Synthetic polypeptide
  VARIANT 14: note = Any amino acid
  VARIANT 20: note = Any amino acid
RALRRIFLGADKRXQPDSAXSASSSCPTCTNKTVNAESHAKVNAETNTKVNVEVNPEIYAGHGADPKGYGTNFACESQWFTYGSRDRLTNTLRSTPSLPQQSSVQHLPASSPGRAVESIMRAPRLPDATAPSPSYRTRSPASRSHQRRPGAGVGVGGGVSQTAPLGKYPSQLQVSLPDACPTYSSSLITSSSTRTANASPPAQAIQSSPGRTVESIMRAPRLPDATTSSFSYRTRSPAGCSHQSRPGAGVGVGGGVSQPVLFGKYPFQSQRVLPDASPTHRSCPSTSTSTRTANASPLPAQAIQSSPGRTVESIMRAPRLPDATTSSFSYRTRSPAGCSHQSRPGAGVGVGGGVSQPVLFGKYQFSTPHTSPDARSDFSATVPPSTFVTLAAPGCVYHGTMEDLGSANSGMPAALTASDPASASSERGFLNVYYQNVRGLRTKTNSVLLALSSCDYDVIIFTETWLVPGIKNSEFAAGYDIFRCDRSAETSSLQRGGGVLVAVKTGRNCKDVELVGCGSLEQIAVRIVLPHQALFICCIYIRPASNIDVYQLHTGAVQQILGMAGVRDLVLVVGDYNLPALTWFFDDDTHSFLPINASAEQEVLLLESMLSCGLLQINNLASAHGNLLDLAFVSDATAAELIDPPCPLLKPDAHHKPILLKLDYDHGGNDDLDDADEIFDFNQCDYALLNERISAVDWDTLLDTSSVDESTANFYERLNSILHEVVPKKIRRMSHRYKLPWWNDELRTLRNRLRKATSRYMESKTAWDKVTVQNIEDEYNALNQESFRSYINNTQRSLKSDPSKFWSYVNSRKNANRTPTDVSYRDLNSTSPAIAANFFADFFKSVHSSDAIPPRDHEFEYVPTHYLPLPLPVLNDEETLKALSGVDGAKGPGPDGIPPSLIKACADSLTVPVKRIFNDSLRKGVYPAMWKVASITPIHKSGSTKKVENYRPISILNCLAKVLEKIVYDRLYAVVRPIISDDQHGFMQKRSTTTNLLTFVHSTVNALESGEQVDAIYIDFEKAFDKVPHALTVRKLRKLGLPAWITNWLLSYLTNRKAFVNLRIARSSTFDIPSGVPQGSHLGPLIFILFVNEICALTNSNTLMYADDLKLFRSVKNNVDCCSLQMDVNALLHWCESNGMKVHVKKCKVISFSRSRNPLRFDYTMGDGCPLDRVNSIRDLGVTVDRKMKFNEHIALTTGKAFAMLGFLKRNTAHFDDPFALKVLYASLVRSVLEYAAVVWAPYHVTLAARIERVQRAFVRFALRKLPWNNPLILPSYEGRCLLFRLQSLAERRTLMQRLFVFDLLRGNIDCRSIRNNVRFNEPARQGLRGERPLLWIPRHIFDYGYNNPLDVCFRQFNEICSCFDYVVSKTVFKTRIS

SEQ ID NO: 2882 - protein, 1354 aa, synthetic construct
  source 1..1354: note = Description of Artificial Sequence: Synthetic polypeptide
  VARIANT 79: note = Any amino acid
  VARIANT 81: note = Any amino acid
  VARIANT 84: note = Any amino acid
  VARIANT 333: note = Any amino acid
GESESRGREHGRVTRPPLAASPGRAVESHVRVPRLPDTTTSSPSHRLIRPACCSLQSRPGAGVGAGGGVSQTATLGKYXSXSQXPLPDARPTSSSCAISSTSPPVRTPNAVRAFWSSPGRAVESHVRVPHLPDTTTSSPSHRLISPACCSLQSRPGAGVGAGGGVSQTATLGKYHSSLQNPLPDARPTSSSCATSPPVRTPNAVRAFRSSPGRAVESHVRVPRLPDTTTSSPSHRLISSACCSLQSRPGAGVGAGGGVSQTATLGKYHSSLQNPLPDARPTSSSCATSPPVRTPNAVRAFWSSPGRAVESHVRVPRLPDTTTSSPSHRPISPXCCSLQSRPGAGVGAGGGVSQTATLGKYPSGLQNPLSDARPTSSSAAFPSTINAKGTSTPCKLRIYYQNVRGLRTKIDAFFLAVTECDYDVIVLTETWLDIEILSPQLFGSTYRVFRNDRNERNSDKKSGGGVLIAISSRLDCVLDPTPVCDTLEQLWVRLTVGASQRVCIGAFYLPPGLNRSIDLIKDHLESIGNVLSHLNLNDSFIQFGDYNQPGLKWIPSEEGGLEIDPVQSRVPLVSSYLIDGFNLHGLSQLNPCVNVYNNCLDLVLVNEVALPNCAVLAAVDPLLPQDIAHPALEMFVDVPAPSATAEPPLNSQQSFNFRKANYAAIQEELSRIDWSFLETAPSIDAAVDAFQSILNNLFTEHVPLRRPPQKPPWSNPTLRKLNRLKTAALQEFSNHRSPFFKSKFNLASKRYRGYNRTLYRRYVIRTQRDLRRNPKNFWSFVNSKRKADGLPPTLYLDDVAAATSEEKCALFAAHFKDAFNSRFASEAEIIEATRNTPINAIECSLTEVANCQVSAAINKLKLSYSPGPDGIPSSVIKRCSGALLSPLTCLFNLSLRQSTFPDKWKASFMFPVHKKGDKSSVKNYRGITSLSACSKVFEILVNNVLFDSCKNYISTDQHGFYPKRSVVTNLAQFVSHCLQEMDAGAQVDAVYTDLKAAFDRVDHGVLLKRLERLGVSASLVRWLKSYLTNRILRVKIGNSESDMFISLSGVPQGSNLGPLLFILFANELSMLLSEGCRLFYADDVKIFTVVRSVLNCSALQRQLNHFNEWCVRNFLTISIEKCSTISFHRKLKPVVFDYAIAGNTLARVTQVRDLGVTLDSELCFTIHLHDIVSRANRQLGFIFRIADDFRDVACLRSLYCALVRSILEFCSVVWCPYQSTWTAKIESVQRKFTRLALRRARNPAGWNTYEERCRVLQLETLERRRHVSQATFVAKVLAGEVDTPWIRAQIQIYTPARPLRQRQYLQLAHRDTNYGQHEPVRFMCSRFNVFSHLYDPNISTPQFQQRARLWYSHQL

SEQ ID NO: 2883 - protein, 947 aa, synthetic construct
  source 1..947: note = Description of Artificial Sequence: Synthetic polypeptide
MNTRALEYRLACSAISYDVIAVTETWLKNNTLSSQVFGNGYEVFRCDREQFINSQKKDGGGVAIAVRQGLNARIVSSDEWKCVEQVWVAIDLADHTVYICVVYIPPDQTNNASVFEINSSSVSTVSSMARPYDELVILGDFNLPRLIWRPSRDGFLYADPELSTQTLHVTEFLDNYSSALLQQINQFPNENNVLLDLCFVSCPDIAPPIAIAPAPLVKDVRHHPPLHLSLPVHLASEFTPIVCEVRYDYRKSDVPSMLELLRSIDWENTLDKDNLDDAVQTFTNIIGYVIDRHVPKKPVTNARVPWQTSELRRVKAAKRSALKKYSKHRTLPLHNYYVRLNSCYKRMSKQCHADHEVRTQKKLKSNPKGFWKYINEQRKEIGLPSSMFLGDKTASNTEDICQLFAAKFSSMFTQEDLSQQQITAAANNVLPNGLALNRITIDRSQILEAATKLKSSNTAGPDGVPSIVLKKCIDGLLDPLAHLFSLSLSTGSFPKLWKHAYMFPVHKKGDKRNADNYRGISALCATSKLFELAVMDPVFFFCKNLISDDQHGFMPSRSTTTNLLTFTTFVTDSFTAKSQTDAVYTDLSAAFDKLNHSIAIAKLERMGIGGVLLRWFQSYLTGRKISVKIGDWLSAVFEAFSGIAQGSHLGPLVFLLYYNDCIHSISVPRLSYADDMKIYCRIDNASDAQVLQQQLINFAEWCKINRMVVNPTKCSVISFSRKRNPIKFEYQICGTSIPRENCVKDLGVLLDTELTYKQHISYIVSKASRQLGFVFRTAKNFTDIYCLKALYCALVRSTLEYCCSVWSPYYENSVARIESVQRRFIRYALRSLPWRDPFRLPSYESRCELINLDTLAVRRNVCRSLLVADVLTSRVQCPAILRGLNIFAPIRTFRNSPFLRVPIRQTNYAMYSALTGLHRAFNFVASLFDFNLSRDVIKRKFLLFFRR

SEQ ID NO: 2884 - protein, 1005 aa, synthetic construct
  source 1..1005: note = Description of Artificial Sequence: Synthetic polypeptide
  VARIANT 155: note = Any amino acid
  VARIANT 192: note = Any amino acid
  VARIANT 303: note = Any amino acid
  VARIANT 1004: note = Any amino acid
MEPESGLRATETARRKTDWRNGTTLGMKTRTRIGTWNVLTLAQAGKLETLGREAVRLKLEILGLSEVRWPDSAEHKMPTGQVLLYSGLRSENAQRGFLLSPNARSALITWKPINERIIVARFRTRVRNLTFVQVYAPTDAADLQEKEEFYSQLSXVVNEIPKGDIRIYAGDFNAKIGSDNTDLERIMGPHGXGEMSENGELFTEFCGNQDMVIGGSLFPHRSVHKVTWVSRDGKTENQIDHICISRKWRRSLLDVRNMRSADIASDHHLVVGEIRLRVARVVRQEEKVGCRFNVQRLSNPEVXRAFVGELQARALEIPDSTVEEEWQFIKDAFAVTGENTLGMLRTQRKEWISDATWDKIEERKQAKAAIVSARTRATKARTRQTYAELEKAVKRSCRRDKRAWTDSLADEGEKAANNGDMRLLYDISRRLCGARTNTRIPVKDRSGQLITDPADQLKRWFEHFEQLLQISHPRPSPQYHPQNVRRINRVNSSPPTLREIEEAVKGMKSGKAPGIDRISAEMLKADAHLSARMLHRLFSKIWDTATFPVDWMQGILVKVPKKGDLTNCDNWRGITLLCIALKVLCKVILCRIKSKIDESLRRQQAGFRSGRSCVDHIVTLRVILEQVNEFQDSLHLVFVDYEKAFDRLDHENLWEALGRKGVPERIINLIKAQYEAFVCRVVHNGVLSDPIRVVAGVRQGCILSPLLFLIVIDEVLAGALDRVQNRGLLWQPIRMEHLNDLDFADDIVLFSQRGNDMQNKLDDLAACSSAAGLKVNVSKTKSMAVNTERAQGFTVAGENVEKVDTFQYLGSQIAPDGGTKLDISTRIKKARSAFAGLRTLWRSNQISLRTKLRIFNSNVKSVLLYGSETWCVSSQNTSKLQVFVNRCLRNILRAWWPRNWVSNAELHRRCQQRPIHVEIRERKWRWIGHTLRKDAHEICREALDWNPQGQRGRGRPRGSWRRSLHQEISAVDGTLSWRQVKAKAENRQQWKSFNAALCSTGEQXA

SEQ ID NO: 2885 - protein, 849 aa, synthetic construct
  source 1..849: note = Description of Artificial Sequence: Synthetic polypeptide
MHSAKTLNQTTITMATKPSEHNKFIGLKKIIAGIHKDIAFLKKCVEHRVTPTSHKIRTKGHTDSKIIRRVELELVKESIKKLYGRLSIKTLECYSLHLKLAKEFPIEFEAFLTKVKVAEKCESERKRKILDNKFRQLISHIAPTMKPVVKPLEEFVVNRSSETFSEEQLTLLNKGLKYAVSSKPNLENIVIDIETVINANSIDEKQTKPPPLLPAQINSVRMTVSKLIREATTKHQDNAEVRVVKELKEKPVYYLKADKGNRVVIMDRDEYDKELLEKLGNREKYSLQRGYTLIDMVKKVENTIKECAGLLKSVGKTAKSLRVPNPTLPRIKALPKVHKPGNEMREIISAVDAPTSRIAKWLVEEFKSMPKPFPSRSIISSQVFTKELLESGPIAEDEIMVSFDVTALFPSIPVKNAIGTLRDWLQSQYEGEPWRQKTIQYITFVKLCMEQSYFQFRDCIYQQRMGASMGNPLSPFMSDVYMAALEHELQTKNLLPERWWRYVDDVFCIIKRDSLTTVLDTINSARRSIKFTYEMEVEGKLPFLDILILREPGCPSSFSFEIYRKPTNTRRTIPATSNHSFQHKMAAYHYFIHRMTTLPLSEAGKQKELEYIFETAEINGYSRTTIQAIIDKKERKLHRTSLTTLTPSAEPLRRAAVEFDYRITRPLRQKLAKFGIDLVFSSRNSQLESILGSTKDPIPTLGKPGIYEVSCGHCDMSYIGQTKRLLQTRLDEHIHTYVKIAMEEKRKGFVPHFKSAVTEHIIEEKHNITASDAVILRHITNPSKLAVAESLEIFKAGNKRLLNKDSGNGSTWLFKLLPIQAQKKNEEVVPTVTTNTDTPAMNLQSRTEH

SEQ ID NO: 2886 - protein, 743 aa, synthetic construct
  source 1..743: note = Description of Artificial Sequence: Synthetic polypeptide
  VARIANT 13: note = Any amino acid
  VARIANT 56: note = Ile or Leu
  VARIANT 84: note = Any amino acid
ARNCFRRVYACNXDTANLQPAELQPKTPGPAVTPVPESTESLTYDFTRCDFEAVNXALSQINWTGILAHCSLDEAVSRFYDALXDVIQLHTPLRRLHPPSNRKPWWNATLRNLRNRLRKARTRLHKRRCQPNIAEVRELEELYESQQNAAFSEYIHRIETDVKQNPRSFWTFLKSRKKGSGIPTEISNGCVEANSVEEQASLFADFFSGVYSTSLPAPCNEVVDHIPTHDLHLPVVHFSIEDVSRALDDVDVTKGPGPDSIHPSFLKNCAASLALPTTIIFNRSLAESTFPTAWKLASITPIHKAGNVHKVENYRGISILSGFAKLFEHLVHGALYPVLKPIIANEQHGFVKRRSTTSNLLLFTSTLLTNIEKGQQIDAVYVDLSKAFDKVPHALLLEKLRRYGLPEWIVRWIHSYLADRKAFVKVRCTSSHLLAIPSGVPQGSVIGPLLFILFVNDLCSVLESDKLMYADDLKVFRSVSSPLDSCALQQDIDRLLRWCTANGMEVNVQKCKIISFTRKRTPLLSSYRMGQNELERVNTIKDLGVTIDSKACFNEHIALTTAKAFATLGFLRRNAADFVDLFALKTIYCSLVRSQLEYAVQVWAPYYAVQAERIERIQRAFTRFAVRRLPWVRPQGLSSYDDNCERLKLPALASRRVLLQRIYVFDLLSCNIDCPTLRDKITLHIPARNLRNPAPFLEVPGHRTNYGYYSPLSACCRVFNDVADVFVFGMSKCVFKTRIKNRT

SEQ ID NO: 2887 - protein, 637 aa, synthetic construct
  source 1..637: note = Description of Artificial Sequence: Synthetic polypeptide
  VARIANT 628: note = Any amino acid
ALKKLKSSKRAALKKFSKCPISVNRLNLNQISNDYRRLNKSLFLAHQSRVQNRLKQNPKGFWKFVNEQRKESGLPSTMIRDGVEVSTSSEICDAFRVQFSSVFADNNLSDPDVAAAADSVPDSGLVCSDLQVSREDFNAACSKLKSSTSPGPDGVPAIVIKKCANSLSEPLLRIFNLSLSLGVFPNNWKESYVFPVFKKGCKQDVKNYRGIAALCAVSKLFEVIVLEFLRHNLSHVVSDDQHGFFPKRSTNTNLVTYISKIQRAISDGYQVDAIYTDLSAAFDKINHRIAIAKLRRVGLHGSLLTWVNSYLTGRTMLVKISDNLSLPFSVTSGVPQGSHLGPFLFLLYINDVNFLLRCPKLCYADDFKLYAIIKRPTDMEDLQAQVDLFADWCRLNQMVLNPSKCSTITFTRKRCPTFFSYKILGNPLTRDSFVKDLGVLLDSKLSFKNHISYLCSKASKQLGMIFRMTKYFRDVNCLKILYLSLVRSTLEYGSVVWAPYYHNDIGRIEAIQRKFTRFALRHLGECPNYETRCSMLHLDPLSVRREAAKAFFVADLFRSNINCPFLTSELNVNIRRRVLRSHSFLVIPGARTNYAFNEPVSSMCRVFERCYPFFDFHLSRPRLKHDIXNFLREAYVF

SEQ ID NO: 2888 - protein, 965 aa, synthetic construct
  source 1..965: note = Description of Artificial Sequence: Synthetic polypeptide
  VARIANT 94: note = Any amino acid
  VARIANT 163: note = Any amino acid
  VARIANT 240: note = Any amino acid
  VARIANT 744: note = Any amino acid
  VARIANT 785: note = Any amino acid
MTNTVNNVQELRFEPINATLKNNLSKENGFKVGHLNTCSIICHHDDVKNIFTRTGFDCIGFTETWLNSDIKDALIKFDNFEILRHDRNSTTRVXGGGVALFVRPEYKTKIIKTSPRDSIEYMFCELKVVSCKLWLVLSINPQPIKSSQLQVVVGVIYKPPTLXDFSFFFEDLGNISSTYNNIILMGDFNINILVSNPMSNNFTRLINSFSLSIVNKSFPTHFHNTGSSLLDYFICSENLXSTLFSQVSVPAVSHHDLIYTVFNLPVPVASLKTISFRNFNRIDKEAVRNDFPNFNFDQLNGIVDCETLASNFNHKLIQLVNKHAPLKTKTILPTSCPWYSREAYNACVDRDLAYRFWKNNRTLENKLIYNRFRNRATNLIRIAKKQYSAKLFDPTLPSKTIWKNFKSLGFRDDPDNLDDKFKPEDVNNCFIQKIENYPTGNRQPTIIPDIVEEDQFKFRAVTEDEVHKAILRIKSDAIGYDEIPLKFVKLFLDLLVPYITLLYNKIISTNTFPTIYKLAIVKPIPKIKNPSNPNDLRPISILPSLSKGCEILLKDQIVQYVTFKKLITPFQSGFREHHSTSTIITKVCQDINASFDSNYVTVLILLDFTKAFDLIDHRIFIDKLKEQFQFSSDACDLMKSYLSDRSQLVQINGVRSQFRSTKRGVPQGSVFGPLAYTLSVNDLPSFITHCNKQSFADDTQIYLSCPVDQLPNKISLINSDLSAISRYCKDNGLVLNTSKTKAIXFSRQNTVLPHLPPIQIDNENVEIVDECLNLGIKMNKHLTWXDHVSLIKKKVYSTLRTLNCHRHTLSIDTKIKLVHTLLMPHFIYGNVIFSKMNVDTERHLQVCFNSCIRFIYNLRRFDHVSQFQRSIFDLSLSKFYQFQLLLFLFKLINFKEPQYLFESLVFSRSNRTNNIIIPVHHTNFMGNSFAVRGARLWNDLPHNLKSITLFSEFKRRCKEHLKNSI

SEQ ID NO: 2889 - protein, 425 aa, synthetic construct
  source 1..425: note = Description of Artificial Sequence: Synthetic polypeptide
LYENIFGCLIANNFVKVVAYADDLNILVRNNHEFDTVLQLVSYFSIYSKIKLNFAKSQYLRFNGCLSGPHQIKEVESLNVLGVLICQNFNKLVEINYDSYLNKLKYTLSLHQKRILNLFQKAWLLNTYVLSKIWYICQIFPPNNKHLAAIKSICGQFIWQGFIFKVPRNELYLPVIKGGLALTDVESKAKSLFIKNILYSNADGNAPLDNFMLGQINNSTLTRNMREWIVKADELKLESHLNSSKKIYDFFIHSLNIKCKTMEDMPNLMWSNLLNNLDSNFLNSKCKTVLFCIFKDIVLNKKKLHLYGIRGTDSKFCENCGLVESVSHLVKYCQTSEEIWRWLKNILNKRLKILVKDPDELLSLSIGDRDFKYKAALWLTVQTIVYNLEKRGFGDLNEFKQGIRIVRFNNKAIFERHFKHFLNIF

SEQ ID NO: 2890 - protein, 1455 aa, synthetic construct
  source 1..1455: note = Description of Artificial Sequence: Synthetic polypeptide
  VARIANT 2: note = Any amino acid
  VARIANT 8: note = Any amino acid
  VARIANT 12: note = Any amino acid
IXRTQRRXFLGXFKCCREHSGKSATPPVPTLNDADDAEFAARVCTAIDSKDTGACFGVDWRSGRFTHGSSDRITCGTIVPTIPASFRSSSQHLPVRVLQSSPGRAVESLMRAPRLPDATTSSPRQRLRTPASRSHQSRPGAGVGVGGGVSQPAPFGKYPSRSQHFLPDVRPTSSSCASTSATQTAIVSPPSFRAIQFSPGRAVESPMGAPRLPDATTSSPRQRLRTPASRSHQSRPGAGVGVGGGVSQPAPFGKYPSRSQHFLPDVRPTSSSCASTSATQTAIVSPPSFRAIQFSPGRAVESPMGAPRLPDATTSSPRQRLRTPASRSHQSRPGAGVGVGGGVSQPAPFGKYPSRSQHFLPDVRPTSSSCASTSATQTAIVSPPSFRAIQFSPGRAVESPMGAPRLPDATTSSPRQRLRTPASRSHQSRPGAGVGVGGGVSQPAPFGKYPPRSQHFLPDVRPTSSSCAGPSATQIANASTLSATVPSQLANDVQPQRPGSVDRRDSSLLTIYYQNVRGLRTKTNQLHLSLSSCDYDVIAFSETWLNAKIVDSELSSDYTFYRADRSRETSVLERGGGVLIGVKKRFHPEPIHLRGGEKLEQIAVRIPLPGKTLFVCCVYIPPNSDATIYTQHSSCVQQLCDLAQGPDEVIVVGDYNVPNLTWHFDEDINGYLPSGQSTEQEVALIEDVLGTGLQQMFDLPNANGRLLDLALVSDSSRFQLIEPPRAILKVDAHHRPFILVLETQSTGTAAEQSGTYYDFANCDTMALNNSIASLDWANLLLVGSVDDIVERFYDKLNEIIREVVPLKHRRPHPNSHQPWWNRETRNLRNRLRKARKRFLKHPTEMLGRELADRELHYEMSLEAAFRGYISGIESNLKREPKSFWAFVKKRKQDKGIPQDMVYRDSSASTPDDSVQLFADFFKTVYSANQPTTSNESLDKILPHELHMPLVCLTEEDVRKVLASTDASKGPGPDCIPPSIVKQCAATLANPLAIIFNRSLESGVFPAKWKVASITPIHKSGNVHNVENYRSISILSCLPKVFEKIVHEFLSRAVQPIISACQHGFMAKRSTTTNLMTFVTDVLRSMESRCQVDAVYVDFAKAFDRVPHQLAVEKLRRLGLPEWITTWLHSYLTSRSAYVKLGGSKSGLFMIPSGVPQGSHLGPLIFLLFIDDLCHWIKNDKVLYADDLKFYRTITSPLDCLALQSDIDSLMRWCDQNGMEANAKKCQVITFDRKLRPITHAYMMGISLLDRVCSVKDLGVTLDRKMTFNEHITSVTAKAFATIGFIRRNTTAFKDIHALKALYSALVRSQLEYAAQVWAPYHNVHIARLERVQRAFVRLALRTLPWRNPPEQTSIEDRRRLLGLDTLLKRRQRMQQLFIFDLLTKRLDCQKLSQLLIVYVPPRNLRRNPSMFRLSVHHTVYGHNQPFDVCCRLFNVVSDRFVLNMTKDSFKKLISC

SEQ ID NO: 2891 - protein, 1002 aa, synthetic construct
  source 1..1002: note = Description of Artificial Sequence: Synthetic polypeptide
  VARIANT 43: note = Any amino acid
  VARIANT 78: note = Any amino acid
  VARIANT 107: note = Any amino acid
  VARIANT 680: note = Any amino acid
  VARIANT 700: note = Any amino acid
MARRLEIRNKRQKPIEKQTTDWRLGSWNCRSLNFLGFEFALAXELQPRNFDVVALQEVCLEEEQVLDWPGRQTNSRFXLSGGKDKKLGTGFIVRGKMQDRVFGFTAXSERMCKLRIRGRFFNYSIINVHCPHEEKTDDEKEAFYATLEEVYDGCPRQDVKIIIGDMNARFGREEMFRPTIGPESLHAVTNDNGQRCIDFAASRGMVVRSTYFPRKDIHKATWTSPDQRTKTQIDHVLIDGRFFSDVTHVRTFRGANIDSDHYLVGVDMRSKLSTVFNQRRSRRAPPFNTACLQNGEVAHSYAQQLEANLPGEEELGAASLEDGWSRIRSAIGSAAEATLGSAIRVSRNDWYDDECQRITAEKKAAYDRKLHKATRGNVERYRQARNRQVAVFKLKKRQQEDRDCAEMEQLFRANETRKFYEKVNRSRKGFVPRADVCRDNGGNLIVNKSEVLDRWKQYFNEHLNGDEADGDGVGVNLGAPAADEQFPAPDLETVKREIRKLKNNRAAGKDRLPGELFKYGGEKLARALHCVISKIWEEEKLPEEWMDGVVCPIYKKGDKLDCGNYRGITLINAAYKILSQILCRQLSPHARRFVGPYQAGFTGARATTDQIFCLRQILEKCREYNVPTHHIFIDFKAAYDTVDREQLWQIMHENGFPDKLTRLIKATLDGVMCHVRVSGXLAEPFGSRRGLRQGDGLSCXLFNIVLEGIIRRAGIETSGTIMNKSYQLLAFADDIDIVARNLETVMDVYTRLKVQARRVGLGMNTTKTKYMRGRGSKDVGPPSLTPLTVDGDELEEVSEFVYLGSLVTADNDTSKEIRTRIFAGNRAYFGLRKTLTSDRVQRRTKLTMYRTLIRPVVLYGHETWTMRQEDERALGVFERKVLRTIYGGVQVSDGVWRRRMNHELHAFLEEPTIATQAKIGRLRWAGHVARMDESQPVRLLFDRAEPAGGTGRRAGKPRARWGDQVNGDIRKICNLGNWRVAAQDRERWKRLLATARVPGALC

SEQ ID NO: 2892 - protein, 1013 aa, synthetic construct
  source 1..1013: note = Description of Artificial Sequence: Synthetic polypeptide
  VARIANT 388: note = Any amino acid
MAARPHAAASLCPDRTVFSCFLSCESQCFCTSSSRLSVFKRAYSREFLLDVGRAAFLELNSAHAEQLRDLGLLRRPTSSPTPTTASRPQRRRHKRRERKQKRGKRGGIRARLTANPHKPSIPTIVLANVRSLDNKLDYIRLLRSTQRTVRDCCVFVFTETWLSDSVPDCAIQLDQLTCYRADRARVAGGKTRGGGLCVYINDAWCRDAVVICKHCSPLVEFMIIKCRPFYLPREYTAILLVSVYIPPNNNNSNRNDALNELYQHISEQQTAHPDAFLIIAGDFNHADLKSVFPKIHQHINFPTRGNNILDFVYTTQRGAYKALPLPHLGASDHITVMLMPAYRPLVKVAKPVQKQIQVWPEGSSDALQDCFDTTDWNMFKQAATYNNXTDLQEYSETVTAYITKCIEDVTVTKTITVRANQKPWMTGEVYRLLETRNAAFRAGDEGGLRTARANLSRGIREAKRQYSRRIAHQFSDSRDTRSLWQGIQTITDYKPPQRTCDSNISLLNELNTFFARFEAQNSTTAQKTPPPPSDQVMMLTPDSVRRSFSRINARKAPGPDNIPGRVLRDCAAELTDVFTDIFNISLSQAVVPTCFKATTIIPVPKKPSPSCFNDYRPVALTPILMKCFERLVMHHIKSALPPSLDPFQFAYRSNRSTDDAISTTLHSALTHLEKKDSYVRMLFIDFSSAFNTIIPQQLIHKLVELGLNTSLCNWLLDFLTGRPQAVRVGSNTSSTITLNTGAPQGCVLSPLLFTLLTHDCTPSHNSNLFIKFADDTTVVGLISNRDETNYRSEVSRLAGWCSDNNLSLNVEKTKEIVVDFRRAHTQHVPLTINGATVERVSSTKFLGVHITEDLSWTDNTAALAKKSQQRLYFLRKLRRARAPPPIMYTFYRGTIESILTSCITVWYGACNASCRKTLQRIVRAAEKIIGVSLPSLQDIYGTRLTRKALCIAGDPTHPSHSFFSLLPSGRRLRSLQARTSRLKDSFIHQAVRKLNSLPNLPPRPSSASGTTEL

SEQ ID NO: 2893 - protein, 985 aa, synthetic construct
  source 1..985: note = Description of Artificial Sequence: Synthetic polypeptide
MVAKVYGLGTARASPINDAQAHRPTPAISGQGLPCQVRARLKTLVPQRKLRFATWNIGSLTGRCRELADVLMRRRVQCAFLQETRWKGNKSRNIGQGYRLIYTGSPSGKAGVAVVLSEELRNGLLEVDRRCDRLMRVRVLIEGVITNLISAYTPQAGCSGSEKESFWEQFEEVLRAIPAAEVIIVGGDLNGHVGRAAETFDRVHGGFGYGRRNAEGENILRTCIASDLAVVNTFFQKTPQHLITYKSGSHSTQIDYLLTRRCHISKVTNCKVIPGESLTAQHRLLVMDYVVTPKKKVAEKRKPRIRWWLLNGTMQTSFRAEVESQNLSTNTETAQEVWDRAQSAIITAGKRVLGLSKGGRVIDKETWWWNDEVQEVIREKKTAFKKWQQSNSPEDRLEYIAAKRASKRAVARARSDRLSPLYDTLETAEGQKLIYKLARARDKATQDIAKCLSVKDSQGTLLCNHASVKERWRCYFKELLNTQHPCSLPTEIPPNLGLIAPITPDETRNCLRRMKNRKAVGPDDIPIEAWKSLGSLGVLILTDLFNRVLNTGTMPHQWRYSYITPIYKGRGSVQDCGSYRGVKIMSHTMKLFERMIDLRLRRECTVSECQYGFQPGSGTLDAIFAIRTLMEAYREKRRALHVAFLDLQKAFDCVPRQCIWWALRFKGIPEAYIDIIRDMYRDSVSMVRTAVGDTKPFPISVGLHQGSALSPFLFNVVLDTVSANIQDQPPWLMMYADDIALIDESRLTLERRVNLWKGTLENGGLKLNVTKTEYMACGSPDSCTIHIGPEPAVKSEKFRYLGSILHESGGIDHDVQARISAAWAKWRDVTGVVCDRRIPTKLKGIIYKSIIRPVLLYGSECWPTLSRHTQELHVTEMKMLRWMCGVTRADRIRNTFIRGSLGVRDVADKLQESRLRWYGHVARRPENYVGKICLDMSVPGARPPGRPRKRWLDTVKQDMRANGLTTADAKDRAKWRSLSRKADPG

SEQ ID NO: 2894 - protein, 946 aa, synthetic construct
  source 1..946: note = Description of Artificial Sequence: Synthetic polypeptide
GHSENTGSPWFVIPGNNGRRREQKAETRKKSGCVDDSGKPHTSHRSPASSYECQIIANKMDELGFSWTMQGLLPLMLTESWLHPGIPDAAVELTDFTLHRHDRNHLSQKQRGGGLCIYISEKWAKDTKAVESLLPRFGVSDSNHCSPDLEYLTVKCRPFFLPREFSSAVFITAVYIAPDANANSALNLLHNAISSQLNKYPEAAHIIAGDFNHVDLKIVFPKLHQHVNCATRGGNLLDKVYSNIKRGYKTIPAPHIGQSDHISLFMLPVYSSLRKRDPPTLKTVTVWPEGASLQLQDCFAHTDWSVFESQDLEEYTTSVLSYIKHCTDTVTTEKHIRVYANQKPWMTGGLGFCALYRHCHHRETHQSVCQPKTLDDRGVRILLKERNIAFKSGDKERYSAARANLKTGIRGAKLKYKHKIEGYLHSNNSRQVWQGIQNITNYRPNPRSVGVDNTLAEELNCFFARFEQQSAEEATLHSLSNPSHVFTVEEDDVRKVLRTVNPRKAAGPDGITGRVLKDCADELTGVFTKIFNLSLSQAIVPLCLKASTIIPVPKKTTINSLNDYRPVALTPVVMKCFEKLVRSHILQRLPPAFDAHQFAYRENRSTEDAIAIALHTTLTHLEHKDSYARILFIDFSSAFNTIIPKRLVSKLNHLGFPFSICLWIQDFLSNRSQRVKVEHHVSSALSLSTGSPQGCVLSPLLYTLYTHDCTPFHSSNTILKFADDIAVVGLITDGDETAYRDEVNQLALWCTDNNLALNTLKTKEIIVDFRRNRPDTLPIHIHGDCVEIVSNFKYLGLHLDQNISWKTNTIALVKKAQQRLHFLRVLKNNNLAQELLVSFYRCTIESVLSYCIPVWYASCTAQEKAALQRVVNTAHKIIGCTLPSLEELFKARCYSKACSILKDSSHPAYHLFQMLPSGRRYRTIKAKTNRLKNSTYPRAVAIMNGH

SEQ ID NO: 2895 - protein, 987 aa, synthetic construct
  source 1..987: note = Description of Artificial Sequence: Synthetic polypeptide
MAARAQREAQGLSSFCIFAVLFLLISGLFVQNSGAFTSYTRQELLDIGLCIPDSFISNLRLIHEIARTPRAGRPARPGGSARRPRRERKQRRGKRGGLRAKLKLTPHRLSLPSIFLANVRSLVNKMDEIRLRINHSKRLWNCNVMIFTETWLNSGIPDNAVSLTEHHTFRADRTADDSGKTRGGGLCIYINKAWCTNSVVVGRHCSANLEFLMVKCRPFYLPREFTSTIISAAYIPPDADAKLAMNELHAAISKQQTAHPEAAFIVAGDFNHSNLKTVLPKFHQNILCHTRGNKTLDHVYTNIAEAYAVTPLPHLGQSDHLSLFLTPKYSPLIDRVKPSVRTIKVWPAGVDSTLQDRFQHTDWGMFASQATHGSHTDIDSYTSSVLEYINTTIDSVTTQKQITTYPNQKPWMNKEVRLLLKARNTAFRSGDAQAYSTSRANLKRGIKKAKHCYKLKLEEHFSNSDPRRMWQGIQAITNYKPSQSTPTATDVSFLNELNDFYARFDRDNKEPYTRITSSTDHSPITLTSSEVHTALSRINGRKAAGPDGIPGRVLKVCAEQLAGVFTDIFNLSLNLAAVPTCFKTTSIVPVPKHSSPTCLNDYRPVALTPIIMKCFERLVLAHLKDSLPSTLDPHQFAYRGNRSTDDAVSIALHSVLTHLDNKNTYARMLFVDFSSAFNTVIPSKLLIKLRDLDIDTSLCNWIMDFLTNRPQNVRSGHICSTTVTLNTGVPQGCVLSPFLYSLFTVDCRPVNRSNTIIKFADDTTVIGLISNNDETAYREEIQHLATWCTDNNLLLNTNKTKELIVDFRKGRTGSHDPIHINGMAVEPVSSFKFLGTHISKDLSWTTNTSSLIKKAHQRLFFLRQLKKNQLSSAVLVNFYRCTIESILTNCVTVWYGSCSVAERKALQRVVKTAQRITGTTLPAIEDIQKKHCLRRARSILKDTFHPAHRQFSLLPSGRRFRLPRTKTSRLRNSFFPRAVSLLNSAPH

SEQ ID NO: 2896 - protein, 1229 aa, synthetic construct
  source 1..1229: note = Description of Artificial Sequence: Synthetic polypeptide
  VARIANT 983: note = Any amino acid
  VARIANT 1073: note = Any amino acid
  VARIANT 1087: note = Any amino acid
  VARIANT 1128: note = Any amino acid
MATGGTGVVITLLVYCYFTSLTAAIRVDPVRMFCSIYPLSYHNDNPHIYKDLGYKRKGNELAKTSTGYGTYALAVTMVYPSLYNKITKKKKAMTTTQSSRTGLIIAICLMLSGDIHPCPGPHHFKTPREANPQTEDKRATLTLQVCSSCTLLCSSAQQANPLLSLCPTPNTLKLSVQGVECVKGAAAVPGWSDGERQGEKTHPRLCVGMSDRSFGREFAGRVCAFRGNKRPDPETQQQQQTFLNDSASTMATNSVNRKRLNPGVVKNRKHAFFNTVNNSKIVWDPKMKPKGLLGRHLNIRSILSKSEQITHLLTNSNLDYLCLSETWLYKYAPSAAFNISGYTMFRKDREGAKGGGVMIYVKDNLQCEEINWLCDYEFECLGLNVRLSPQMSFKIIVIYRPPSSDGTFYDRFEKLLKESNLNKETVILGDFNINWEDTSCRNKLKRITDKFDLVQMINGPTKITTSSSTQIDLIFTNRPERIIKTYNMLAGISDHNLTLVARKLSKKRFKFSAREHEFIGIPRNRRDGFKNAVEQIDWDRLLLGTDLEKDRGSFVGTIEKTVKNSALNLNANTIKIYYPGLTLTYHTKTNERERFCVKKVIKSKSASDRNMFTTLRNRVVKNIRKAKADYFLTLIEKAKGDSKTIWNQLKKVVRHDTKNKKMLEVMIDGHITNNACKIAEAFNNFLLTQFQIWSHCVHQKFLTCALFFINSVSNMVPLCPSKISNMCSLNSSQPIFSISNISESDALQAIKSLKSSRTKETFGIDSLMLKELSSTLLTPITKLLNRSISEAIFPCVWKSSAVIPIFKNGDHYSLSNYRPISIIPTVSKVAEKLIANQLIKHLNTTTFSLHPMQFGFRSQHSTETANCFLIENIKHLLDKGGVVGAVILDLKKAFDTVNHKILLSKLTKFNMSPESLKWFESYLSNRSQSVRINNYHSSPLSLPTGVPQGSILGPLLFSLYINDLPSVCQNILIQMYADETVIXTHGKNTTQVAEKLTQAMAHVSEWLNQSCLKLNVSKTVAMYFSKTNIVNNLTDIYVDGDKLQIVSDFKYLGVQIDSKLTFKSQIKKVCNRXKFNIRSHLSLQAAXIFMHSMILSHITYCLTTWSQANKTTLKPIESLYKQSIKILXKKPLRHHHCSILQKHKLLSWENVIKYSNICLLYKIIHGLSSPPLSQFVNIRNSTHRATRGAARGELYRPTPEKYLWSGCLFSYSCTGVEFCPWQHQRYNLL

SEQ ID NO: 2897 - protein, 290 aa, synthetic construct
  source 1..290: note = Description of Artificial Sequence: Synthetic polypeptide
  VARIANT 26: note = Any amino acid
  VARIANT 226: note = Any amino acid
  VARIANT 274: note = Any amino acid
VRNHSINFHCYADDTQLYLSIKPDEXNQLSKLQTCLKDIKSWMSCNFLMLNSEKNEILVLGPKNLRDSLSKDIVTLDGITLASSTTVRNLGVIFDQDLSFNSHIKQTSRTAFFHLRNITKIRHILSQTDAEKLIHAFVTSRLDYCNSLLSGCPNKSIKTLQLIQNAAARVLTGTRKRDHISPVLASLHWLPVKCRIEFKILLLTYKALHGQAPSYLKELIVPYYPXRTLRSLNAGLLVVPIVSKSRTGARAFSYQAPLLWNQLPVVVREADTLXTFKSRLKTFLFDKAYS

SEQ ID NO: 2898 - protein, 1142 aa, synthetic construct
  source 1..1142: note = Description of Artificial Sequence: Synthetic polypeptide
MKAFMRQTRKALTEFRKQLTSSFEVFSIMETQFLDCKLLNESPKRKIANNNKNSLQIPSPCIAAVGIPSPISACLNSILAVNNSAGPGTSGLQSSFAFNNTSPGSEPGASGLQPNQNTGTTAEGSSTPQQLAPGPGSLHINPDHATTIAPAALPSSQPAANQPLSAIPLSGVAPRSNAADLPLRGIAPNRSVFVSRLNPEATADCVKSYLCQKLGAQPNSISVFKFNFKQPRNISSFKITLPESMFSNALDPTIWPEHTIMHEYIRKGASQDPNSVDAKNCKKLNRSISVAYQNVRSLLGKLKRVYSNSTLLDFDIIAITETWLNTTVYDQEIFVNKFAIYRLDRPTRGGGVLIAVLNSHSSELIPYDNMHSIEFIAVKVTTDKCNVFLTCSYIPPGSDPAIYLHHLSAISAVSLAVGDADQLIVLGDFNLPHLSWLPNSDSNILFPENQHEFIDGLTNLSLGQVNSIKNSRERILDLIFVSDVSVATVSRCDPVSTPEDSYHPALYLSVHINFETTNQSASQRGNTIRDNYESICLTTREHYTGLNSHFDRLNWSTLYSFTDLDSAVLWFNESVCSALDTFVPSYRWKLIKASLVLQAFVLHIPLSQVTVGNSLKPPWFSRHLSYIKNTKSLLKDIKNPRFFYAEYIAECRQNIRSDPKKFYSFVNSKRKSNVFPPCLHLGNLSESSDINISNLFATFFQSTYSLPHINNIHIPPFKISDVLNGMLTIDESFSAGPDKIPSCIIKQCAASLCGPITFLFNLSLQLSFFPSVWKTSFLIPLHKKGSKTDVGNYRGIAKLSAIPKLFERLVTCQIQHMCSSIISTSQHGFVKKRSPSTNLLEFSRLIHCSFLQKKQADVIFTDFSKAFDSVNHSLLIYKLSLIGFPPYLLDWISSYLSNRSQRVLFKNVVSSLVNVTSGVPQATSHLGPLLFILFINDLPQVMSYCTTFMYSDDVKICMSFSNLSSHLLIQSDLNKFQAWASTKLLSLNYSKCKTMSFSRTTFHTTSYTLGNSLLERVVKINDLGVLFDQKLCFNSHISVMVNKATGVLAFIKRWAKEFNDPYTTKSLYVSLVRPIMEYCSEVWNPQYVYQQNLIESVQKQFLLFALRNLNWDPDRHLPPHLSRLKLIDLNTLKHREFNCKIF

SEQ ID NO: 2899 - protein, 824 aa, synthetic construct
  source 1..824: note = Description of Artificial Sequence: Synthetic polypeptide
  VARIANT 759: note = Any amino acid
  VARIANT 806: note = Any amino acid
MGDFNAKIGPNFTRMRSATGGHGIGTRNNNGDRLVEVCQMFQLIIGGSMFPHRDIHKYTWTSPSGNTRNQIDHICISRKWRKSLLDVRNKRGASIDSDHELIIGELSIKLDRNRPRNADDSRNHRPSPLNIHLLGETDISARLASTLRTHLLPQQGQTWEQTCDTLRTTAEGIIGTQQRRRNNWISSATWDTINKRNSLKLLADRDSNRRDEHRALCKAVKRAARNDKRALLDRLADNAERAANENNMRSLYQTIEQISGGYRRKTQPVKDANGILLTSDDDQIHRWRQHFMEISNSDMPSRSDDYRSVAPANGNRRISSAPPSVREIGNAIKKLKNNKAAGMDGIPAEILQVDTQLMAEILHPHFSSAWESEHIPDSWKCGVIVKIPKKGDLSDCNNWRGITLLNTSYKVLATILNERLTEKFEPTLRDEQAGFRPHRSCVDQANTLRIITEQAVEWRAPLYLLFIDFKKAFDSINRAAIWGALARKGVPHKVIALIKALYDDANLAVLHNGKTSAPFQTNTGVKQGCPLSPLLFNIVVDEVMREVCKHKRGITWSFTRHLEDLDYADDICLISHKLSDIQSKVDDLVNLASRVGLQINTAKTKAMRLNHASQGNIIVDGNPIEYVESFPYLGTVISSNGGVTEDVTSRLAKARSAFGRLYRIWRSRQIRRKTKIRIFNSCVKSVLLYGSETWLTTKTIIQQLQAFTNKCLRIICGIFWPNRISNIDLWNMTGETAIRLQIRKKKWRWIGHALRKDQXSIVRTALEWNPQGSRRVGRPKATWRRTALQELSQYNITWDTAKQTAXNRVRWRNLVEALCSQEEL

SEQ ID NO: 2900 - protein, 393 aa, synthetic construct
  source 1..393: note = Description of Artificial Sequence: Synthetic polypeptide
  VARIANT 14: note = Any amino acid
  VARIANT 41: note = Any amino acid
  VARIANT 43: note = Any amino acid
  VARIANT 62: note = Any amino acid
  VARIANT 108: note = Any amino acid
  VARIANT 113: note = Any amino acid
IVNNKWTILKEHTXTPSKVFLDIVKFCIQDNRYLKYETKLXIXLKGMPMGSPASPVVADIVXETLLQNTTEKLRRPPRLLTKYVDDLFGIIKEDEIENTLTTLNAFNXNIKFXMELEKDNCIAYLDTVVIRRGNELKLKWYKKPIASGRIINFNSRHPKMMIRNTASSCINRMLRISDAIFHEEIINEIKTILTNNDFPKHMIKSLLDKYLKSDNNQRPPKKERTYISVTYVPGLSERLAQSDCYDKENILIAHKPDNTLKQIFNKTKSKIAPTDKKDVVYRIPCNGDGKNNCNSIYIGTTKSKLKTRLSQHKSDFKLRHQTNTQKTALMSHCAKQGHSPNFEETTILAQEQHYRKRYMMEMLHIINTPTNIRMNYKTDTENCAHIYRHLLGK

SEQ ID NO: 2901 - protein, 996 aa, synthetic construct
  source 1..996: note = Description of Artificial Sequence: Synthetic polypeptide
  VARIANT 400: note = Any amino acid
MKEAEEASERDRFNVDDHGKRKKDNDLRVCTWNVRTLYRPGAAQQLADTLKKCRADIAAIQEMRWIGQGCIKKKDCDIYYSCHPERHEFGCGFVVGARLRRRVSHFLPINERLATIRITAKFFNISLICAHAPTEEKDDVTKDTFYAELDRAYGRCPSHDIKILLGDFNAKVGREDIFGATVGRFSLHETTSSNGLRLIGFAAAHNMVVRSTGFRHLDIHKATWLSPDRLTRNQIDHVVIDARHASSVLDVRSCRGPNIDSDHYLVAAKIRTRLCVAKVARRGLLRRLDIGKLQSQQTRDAFSTQVSGLLSRTTPTPEDISDQWALISHSLRTSAEEVIGFQRPPTRNPWYDQECRDATAAKDAAYRRTLQAGATRAVVEVYRLRRRDEKRLFRRKKREXEKRECESIESSRCRNEARNFYQRVKRLTQGCKTGGVACKDNDGNLVTDAEIVLKLWRDHFSSLLAGSGTGYEDYDPQTPIYGTDIDVPTPSHAEVKDAIQRLKNNKSAGADGLPAELFKAAGDMLVGSMHQLISKIWRTESMPEDWNLSMICPVLKKGDATLRTNYRGISLLPVAYKVLSSVLCENLKPHAEALIGPYQCGFRPGKSTIDQIFTLRQILEKSYENQIDTHHLFVDYKAAFDSPRRDRLYAAMSELGIPAKLIRLCRMTLSNTISSVKVGNDQSETFSTKCGLRQGDSLSCMLFNILMESIVRKAGVHRTGTILSNRCVQLLGYADDIDIIGRTKRDVTAAFGAIEKESAKVGLAVNMDKTKFMVCSSRESRRLDSQLTADSYSFESVKEFIYLGTAITSTNDVSLEIKRRVTLANRCYFGLSRHFNSRALSRQAKITLYKTLILPVLLYGAECWTVVQSDAAALGVFERKILRKIFGPICVGDAYRIRWNHELYELYGDVDVVSRVKIHRLRWLGHIARMEEDAPARKVFDAVIVGKRRRGRPRMRWQDQVMEALSTSGAANWRRRAQDRDAWRQIVQQAVTRQGL

SEQ ID NO: 2902 - protein, 996 aa, synthetic construct
  source 1..996: note = Description of Artificial Sequence: Synthetic polypeptide
  VARIANT 835: note = Any amino acid
  VARIANT 955: note = Any amino acid
MQLIQLNLNHCRAAQDLLTQTVRERGSEVAILSEPYRIGNSRDWATDRTGKAALWLCGVGAQQMCDIKAADGFVRANVGGTWLYSCYLAPSLSLESFGRILDELSIDLRGHSNVVVGGDFNAWAIEWGSSRTNARGRAVLETFASLDVVLLNEGSRQTFSRAGAGSVIDLTFVSSALARRARWTIGEVYTASDHEAIECSLGMAGRPSGPPPLPRRAFRQDTFRPRAFASALEGFAVDEADGANVMANKLADAVEDACDRSMLQRRPFRGNHRPVFWWSEEIAELRRICHRSRRLLQRARGSPLLVECSERYKAARKALKIAIRDSKRESFLKLCDAAEEDPWGGAYKMTVKKLNAGGNAPSDPEALEGIVRALFPDGQPVGNFPRAEPGEFRSVTEAEVLQAGRNIKPKKAPGPDGIPSRATKLALALLPEQVAGLFNKCLQEGTFPVRWKRQRLLLLAKPGKPPGEASSYRPICLLDIIGKVFERVIATRMTEAVEAAGGLSTEQYGFRKGRSTMDAIMKVVKTAREAIAGSRWKGGTKSYCLVVTLDIRNAFNTADWGRTLESLRMFNIPSYLLNVALSYFSNRVLTTDTCLGSRAYKVSAGVPQGSVLGPLLWNAMYDGVLRLPMPEGTSLVGFADDVAIVVVAKELATVEAHADAAVQAVESWLANAGLQLAAHKTEAVLVSSRKAVETASVRVGGTTIRSQRAIRYLGVLLDTRLCFKEHLEFVHKKASGTAGALSRMLLNTRGPKQATRKLLTTVVTSQMLYAAPVWAEAAKVKSYVRGVEATYRLCAVRIACAFRTISEDAALVIAGQVPLTELVRERAEIYAAAQXREATQQTRAESKITARRRSLENWQNRWDSSQKGRWTHTLIPNLTSWVERSHGQVDFYLTQVISGHGCFRSYLKRFGHETEDWCPVCGSGVVEDARHVLFECHRFDHERQELEAVAGSSIXAETLVPMMLADQRVWEATATFAADVMKSLREQERRRKEQTE

SEQ ID NO: 2903 - protein, 430 aa, synthetic construct
  source 1..430: note = Description of Artificial Sequence: Synthetic polypeptide
SVAPCDNIFNFVCVSQCDVLDCILKVKSNAEGLDNINPKFLKLLLPCLLPYVTYIFNSILTQSSFPTAWKLAKILPIPKQNNEYRPISILPFLSKVFENVLAGQIQGFLDRNLLLHNKQSGFRRKRSCLTAITDITEDIRQQLDKNHVTILTLLDHSKAFDSVNHNILCTKLKNLFNFSDSSVRLIASYLTDRLQAVVAGAVTSAVKKLTRGIPQGSVLGPLLFAIYVNDLPNVLSDCEVHLYADDVQIYVSSPVREINVCISTCNRMLSLVQTWAEHNGLSINPKKSKSILISRRPIDTNDLTKPIINNIPISYVDHAVNLGLTFNNTLSWGNHISKATGRVYGILRQLANTRNFLPEHIRLLISKTILIPTLFYGIEIFGFCDTRDTRKLVTALNSIVRYVFNLNRFDHVSHLTTKLLDLNLNSWINL

SEQ ID NO: 2904 - protein, 846 aa, synthetic construct
  source 1..846: note = Description of Artificial Sequence: Synthetic polypeptide
  VARIANT 284: note = Any amino acid
  VARIANT 286: note = Any amino acid
TIDPAEIANTLGDLWSKQAKDSNFSPEFRTNKMLITPHNTYAPTPTAIEIEKNINLIELNSAINSLKGHTPGLDRISYSMIKNTPISFKFRILQHFNDILDSHIPQSYKLSLVLPILKPNKPKTNPNSYRPISLNPCLAKVLDKVVANRLWWFVLSNKLIHNNQFGFKRGRSVLDSLLYVDHLATRSLSLKKHISIISLDFAKAFDKIGIHSLIHQLEKWKLGPRIIKYVWNFMTNRKIIVKNGTSLSISFPLDNGIPQGSPISVILFLIAYNSLTNIISIPNXLXFTAYADDFHLILQHNRNNNPQVNLSTLFHQIGEWCSYSGSSLSIDKCQLLHICRKRSCRANIITGSINIPTTDHTKILGLTINKRYSWNHHITNLKTSLSRPLNIIKHLSSRKYNCNTTSLIQIVNSILISKIDYCLPIYGKAPTSILNCLKSTQNSAIRAALGAFRTTPINNLLIEAKINTLENRCKLLTSKLGTKLILSHNSPIGKLSKSIAKTKRNYRYPSTLDRIIDSCKSFSLPFSPAKFYTSKKYNPGIILKATNTSLSLYNKNTTSPITYHQLFHSIKNSLHDHKFIYTDGSKTNDTVGYSVTNNTDIIKSGLLPQYSSVISSELIAIHEAIKICSGSPGKYAICSDSLSSIKSISNVNNYSYYPNTIRSLITKLFPKIRLIWIPSHIGIQGNERADTAAKETHKYPLIFTDNFNTKDITQLLKKHYTDKLNSLQAQTTQWYKQILLNTPANFSFKTTNLNRQQQIIINRLRLGHTQLTNAHYMNRSLTSICPFCNTSAIDIQHILIDCTALSHVRTICFSNDNPIHLLANPTAANSNKIIYFLHKMNLIHKI

SEQ ID NO: 2905 - protein, 900 aa, synthetic construct
  source 1..900: note = Description of Artificial Sequence: Synthetic polypeptide
  VARIANT 405: note = Any amino acid
  VARIANT 469: note = Any amino acid
MHNICATGNFSYILEMEGSVDVSHSHTLLRILAKQRSGLKICHINAQSLPKKIEEFRYMFVNSGLDVICVSETWFVQDFRDSLISCDGYYVYRGDRVSHGGGVAIFVSKKLKTKFVCKHPDNSQIEYIFLEISNKFASSKILIGCIYRPRCDITYNEIISLLGDISLNYADIIVAGDLNSNMLRETHLKNEFESIGVHLVNSVFPTHFSRTCSSLLDVFFVSDVKKVYLFDQLIVPSFSKHDLIYLTYNFDLQYNDESIVFRDFKNLDYGLLMTEFDKCNWNNIFVSPTVDQQLAQFQNNISYLYENFVPVKTKVIKHSVKSWFNNDIKLAIKSRNDAYQKWKRYRTPEHYGRFKLLRKTVTKLIDSAKTNFYSSRFQTTASTSRTWKEIKSLGIGRKPAAPEQXVDIEELNTSLSKCNVPEICENNMYLRSVPRNLCDSRFRFVCVNQCEVLVNILKIKSDAVGLDDXNPKFIKVLLPKILKYITYIFNTAFTTSTFPDRWKIAKIIPVPKANKEYRPISILPYLSKAFENIMASQINSFIHDNALLNNNQSGFRKHRSCTSAILKIANDIREYADNSNVTLLVLLDYSKAFDTVNHNVLCAKLVNQFKFSKTAVKLMTSYLQNRRQSVVVSNVSSSFAFTKRGVPQGSVLGPLLFTLYVNDLPSMLSSCDVHMYADDVQMYVSRPLNRINECVDICNNELVKISNWAKENGLGLNPSKSKCIIIYKKKLSLNIGPLLLNDSPIEYVERATNLGFIFNNTLNWSDHINTAVGKTYGLLRSLYLVRNFLPLNVRMLLAKSCLIPTLFYGIELFANCDSNSQHKLKMAFNSITRFVFNLRRFDHVTRLSYNIFELHLADWIKMRVLVYLQKIIFSKLPIYLYETLRFSTSRRSNIIIQIRH

SEQ ID NO: 2906 - protein, 966 aa, synthetic construct
  source 1..966: note = Description of Artificial Sequence: Synthetic polypeptide
SSGPRASDSFNQRSKKLNNSFSLHYQNVRSLLGKLSKLHVNSVSFDANVIAFTETWLNSSVSDCEIFAGSYVIYRCDRSMRLGGGVLIAVKSDLVSQRIPIIGTDSILEFVAVRIKLHDYFVFISCSYIPPRSDISLYLQHLAQIQSIHSTLGYNDHLIVMGDFNLPDISWMTSTDSIALVPTTAHEFVHGLIDLSLGQLNSILNCSKKVLDLIFVSEFANAFVTRISPLSNPEDAYHPTLEVTLEASAPLQSCSEIEPASFRCFRRAKFAELNRHLSELDWSFMDSNDDPLHIVEQFYGILYSAFDTFVPSFPSANAPQKPPWFSRRLSFLKNSMSRLFKKFKRTGLQVDHSMYLIARSNFLVHNSVCYNGYLNRCRIEFQDNPKQFYAFVNSKRKSQQFPSCLHLDTTSASSDADIANLFAKFFQSTYSSFSYDNTSSYPYPFLTPTVIFTPLISEDDVLQNLKTIKMSFSSGPDLVPSCVIKKCADALCKPLSKLFQISLLHSFFPEVWKESFIIPLHKKGSKSDIKNYRGIAKLSAIPKFFEQLITAQLQHQCSSVMSPTQHGFMKRRSTTTNLLEFTSVIRSAFKNNIQTDVIFTDFSKAFDSVNHQLLLKKLTLLGFPIMLTKWISTYLSNRTQRVAFKSTISNSVHVNSGVPQGSHLGPLLFGIFINDLPQVVLSSYVMMYADDVKLCLPLSNPNSHDLLQADLNNLHSWCIQNLLFLNNSKCKLMSFYRKRLLLTSYSIGSNDLERINSVTDLGVLFNHNLNFSDHIGTIVSKAKGVFAFVKRWSKEFEDPYTTKHLYISLVRPILEYCSCVWSPQYTNHQDLIESVQKQFLLFALRGLNWETHRHLPSYVDRLRLLNLPSLKDRRTCHGVMFLHKLITGLVNSSYLLGQIRFSIPVRSTRYFRPIALDICKTNFEVHDPFRVLCSQYNELYFLIYSECSVNLIVTNILTHLSLPPPT

SEQ ID NO: 2907 - protein, 998 aa, synthetic construct
  source 1..998: note = Description of Artificial Sequence: Synthetic polypeptide
MMRLIQLNLNHCTAAQDLLVQTVRERRVELALLSEPYRTPASPDWAFDRTKKAAIWRCSRETQQITDVLSDIGFVRARVGRWWVYSVYLAPSLTLIAFSRALDRLAADARGRTQVLIAGDFNAWSESWGSSTTNARGRMVLEAFATLDLALLNHGNRHTFRRAGLGSVVDLTFTSGSSYRLARWRLSEDYTGSDHLAIICDLGSPPSSQAQTPAQARIKYKTDSLDTQVFREQFLPTASRQGAELTAVELMRRLKAACDASMQSSRPHSRQRAPVYWWNQEIETARRECLSARRRYQRARGAESFAERQSEYRARRKTLKLAIRESKRKCFLDLCDSADSDPWGSAYKVVVKKAYTRTPKLLDPAMLRSVAEHLFPVMDGLRPADPATGDHVDSDATVSSDEILELAKLLKDGKAPGPDGIPNRALRLALHLQPDSFAKAFTKCLEEGVFPSCWKIQKLLLLPKPGKPPEEPSSFRPICLIDGTGKLLEKLVCIRLERAIADAGDLSRSQFGFRKARSTVDAVNRVVEVAAQAIDGTRWKGGSKEYCLMVTLDIRNAFNTARWDRILEALIGFSVPAYLVRIIRSYFSDRVLLCESSEGVFRHQVTGGVPQGSVLGPLLWNTMYDGILRLPLVGRSEIVGFADDVALLVVDKYPGKAEESCNQNIRAIEHWLSSMGLELAPEKTEAVLISSRKAVETATVEVGCTKVSSSRAIKYLGVMIDTRLSFREHLAYANSKAAGVNRALSNIMLNSRGPKQASRRLLTSVTRATMLYAAPVWAKALGTESYAQGLNATHRLSALRVCCAFRTVSNAAALVIAGIPPLDLLAKENEVVFNQTHGRRLSPGVKKAIRAEARQHTLETWQHRWTNEPKGRWTQQLIPNLKPWLERKHGDITFHLTQLISGHGCFRSYLMRFGHEDADDCPWCGGGRSETAEHVLFSCVKYARERSSLETVLGGRLNADNLVPFMLQGEAEWQAVNSFAAAITTELRRAERARRVHE

SEQ ID NO: 2908 - protein, 1029 aa, synthetic construct
  source 1..1029: note = Description of Artificial Sequence: Synthetic polypeptide
  VARIANT 910: note = Any amino acid
LRRLPHLPRPKPQNNYQPNCPTHLSKSHRNRLYTKCSHSPNPLKWHPCKYDNCCPIYCPPVYKWTHENFHKLFSHFETLLDGKSNFILSGDCNSKHRCWGNYSSCARGRSLMQAIMANKLLDVVATGQATHFPFDRRKQPSALDFAICKGLRRRITRTFSSDDLSSDHLPIQIILDLEEANLQLKKVSNSILKRNTNMEKFKRILEDKMLLNTEIRTGQDIDDCIDIFLNNIKTAANEATPKNRPFTNPRENSRRRENNLSLDEATTRLLDEKKELNRILRAAGTEEAKKWFKSAQNKLAKEIRKLRTSQINNELQLIDTTDRYRMQKLWKWTNNVKKQPQPIWPLKKDDDCISMRTASPWTRTLDERAEAFASHLESRFKANLRNSIEDREIIKKELDKFKSLKPRIETGTSGLKPVTLAELDLLIKSLESKKAPGADNISNKVISNLPKKARIYLILIYNKILNTGHFPKKWKHACITMILKPGKSPSLLNSYRPISLLSGLSKIFERIILNRLYNIESFSKAIPNHQFGFRKGHGAEHQLARVTQFILKAYEDKEVCSATFLDITEAFDRVWHDGLLLKLTKLIPKQLFNVLESYLTGRTFQVRINNETCSRIGTINAGVPQGSILGPVLYSIYTSDMPFPIIKGYIRNISLPDYHPKNIILATYADDTIIISRSNNTRSAININQTYINKFCRWAKKWDIAINGKKTGHVLFSLKNISENVHTTPIVDGQRAIKLCKHGYLGVMLDRRLTFGAHLILLKGKIIAAYKRLEWLLGKNSHLPKRTKLLLWKQIISPIWHYAIAIWGSLTSATQTKKIQTLENKLIRRIIKANRYTKQSAIREKYKIKSFEEVFDQASKRYANSIADHENPLIKELLTKSFKPIRLAASRTRYVNQYTKYLLPLLQNIXKPPDEPTYKSLYSYTDKEELEIVSKIRYDYRQTLPTLLQLEDEEMEARDCKAEEERKEREKEERKKALEKGPPDRWCELLINKFSKMYKKGMITRERVIELMLGQPPTVIKLVIPDYEP

SEQ ID NO: 2909 - protein, 861 aa, synthetic construct
  source 1..861: note = Description of Artificial Sequence: Synthetic polypeptide
MSTTGKKEIRKEIGREEQPSEEDTKEFLNKIYNRGKRIKKENERIKEIIEESNRRNLKRIIITKENIENVITRIPSWKAPGIENMHGYYWKRLESVRDRLVIVFNEWLDTPENIPIEMLTGRTILIHKGGDSKKAENYRPITCLNVIMKIFTSIINRKIEEQLANNEEKYQINKSQYGNKKRSLAAKEVNINSLLERNEREVQKKRYLESFYDIRKAYDTVNDEWLENVLRYFKIPFQITELIKSMSSRWRIRIGYRYKEEIREVKIKNGILQGDSISPLLFILQMNIISDVIDRTNEKRLKVKHVLYMDDIKVTSETKKGMEMVHKNIIETIEVIGMEVNVNKSGVMKKGNIGIQDNMKDIPIVDSEHQYKYLGVYQFTRNDDVGCIERISKSIEEGIKENNKGNDSSMNYINRINTEIIPKFTYSASVVKLPIMKLIEIDKMIRIEVKEGKIIGAGMCTSRLYVNRNKMGDGLKSIRDEYAIKLIRSILYYTWKRGNRIGDMIGINENKNRMLNRLYKSMLKKRINKEEFRKIVEEERGKRDKNRIIKYVREKFQEDYINKWRNKKVNSEILKGFEDKTMEQKKTIKVWKGINVIRKAYIQIKKMEEKARNVGVRKALMKHDMRYAICPICNKIATINHILLNCIVTKKTQMNKHDRIGEYIWRSLKIKYQLYENKEKMKMREEENTKKLIIRKEELGKNERRIEKDKILIVWNHEVVNRSEDKFHKRIDIYVRDLNKKEAMIIDMTIVRDKNISKAFTDKINMYSKLHEHIRKIERLVRVIVIPVVITVSGLINKETVILLNAEGIEIPREIMTREIVISNMKDLMRYCGDHSGEYSNVEIPEEEDSQESEGREEILT

SEQ ID NO: 2910 - protein, 982 aa, synthetic construct
  source 1..982: note = Description of Artificial Sequence: Synthetic polypeptide
MVQNNPMYKRGRGGVTLPGGSPGPPSGARPRGRARRRAPGGRVCHGARSGIARKSNVAPPSPSYGPTTHGRNRWGRVRCHMGGSEGQGPRRTRPGRQGLALGTWNVTSLWGKEPELVREVERYQLDLVGLTSTHSLGSGTVLLDRGWTLFFSGVAQGVRRRAGVGILTSPRLSAAMLEFTPVDERVASLRLRVVGGGISDCCLCICPEQQFGVFGLLGDPEWSPVWGSSRGLHNSAGGLQRTRGQFCDRVIGSETACFGHSGKERGGAVNRSPSGGELGQGVGEDSGQTGKTQTGSAGELGTSGGGPRPKDLHSHLRRSFSGIPVEVGGIEPEWSMFKASIAEAAAGSCGLKVLGASRGGNPRTPWWTPVVREAVRLKKEAFRDMLSRRTPETVAVYRQTRRAATSAVKEAKQRVWEEFGEAMEKDFRSAPRCFWKTVRHLRRGKRGTIQAVYSKDGTLLTSTEEVIGRWKEHFEELLNPTNTPSIVEAELEADGEASSISMAEVTEVVKQLHSGKAPGIDEIRPEMLKALGVEGMSWMTRLFNIAWESGKVPKEWRTGVVVPLFKKGDQRVCANYRGITLLSLPGKVYSKVLERRVRQIVEPQIEEEQCGFRPGRGTTDQLFTLARILEGAWEYAHPVYMCFVDLEKAYDRVPREILWEVLREYGVRRSLLRAIQSLYVQSESCVRVLGSKSDSFQVGVGLRQGCALSPILFVTFMDRISRRSRGGEGLQFGGLGISSLLFADDVVLMASSVCDLQHSLDRFAAECEAVGMRISTSKSEAMVLSRKPMECLLRVGNEALPQVKEFKYLGVLFASEGTMEREIGRRIGAAGAVLHSLYRTVVTKRELSRKAKLSIYRSIFLPTLTYGHEGWVMTERTRSRVQAAEMGFLRRVAGFSLRDRVRSSAIREELGVEPLLLCIERSQLRWFGHLVRMPPGRLPREVFQARPAGRRPRGRPRTRWRDYISTLAWERLGIPQSELANV

SEQ ID NO: 2911 - protein, 1080 aa, synthetic construct
  source 1..1080: note = Description of Artificial Sequence: Synthetic polypeptide
MMTPTSTTAANLSTHDDQHCPISTCPGASNTDQWILCDHCQKWYHTACVAVVIIPEEEWLCPTCVISVTSSQSQVTPSSLNTTTTTKKKHIIATTQYWLKSNLVEDPLGLIPKSEIVARYAHHIQTSGEGRVVDATVGKYILQLFPSTKFSRPPTRGAANAYIGIRWKDQPPLLPHAPRNWGAELSQLKNTVPTLRRVPKGARMEVAKALAKIIEEVTTTNSEESWFKLFSFPYAVVPVPTKSDKVKNLTTWVKSRVLQWSITQIVTPSRPRPQFAKPSRPQETIAKKVEAKLADGDVRGAIRLLTSDDTIAPNNQETLDALITKHPPHPEPTYFPNAPDKAEVLAPVDPKEVLIAISSFAPGSAGGLDSLRPQILKDLVISENGEPATNLLNAMLKFLDLVLRGDVPKSICPIFFGASMTALRKKTGGIRPVAVGNTWRRLISKIAVARMSSTLVEIFSPHQLGVGIKGGAEAAAHAARIYWNYSHDSPKAFLKLDFRNAFNEIRRDTLLQIIREKFPNFYRFVSQAYSSPSEIFFAGTPISSLCGVQQGDPLGPALYALVIQPIVDLIDTELNMWYLDDSTIADSPEKVLMAMQTITRMGTEVGLHLNTTKCEVGILGVVDDQTRDEIFELFRSTAPGIQKISPESAMLLGVPLTDEAIPTILGAKTEEMEKISTRLLKLSSHSAFFLLRASISTPRLIYFLRCAPTWRRFDALTLYDAKLKNAMEGIINCSLSPQSWLQSSLPVNKGGLGVRHAIDVAIPCFLASIYSSLPLAERLLPPHLHGIDTAIQEGEERWKSLGSSPLPPLEIRGIQAIWEIPQQEGVINHLTTNATTLEDKARYHAMSQPNVGAWLNAIPSPQLGTHLPNETFRIAAALRLGCDICQPHKCSCGEQVSTKGYHGLSCKNSAGRHSRHAAANDVIARALRSAGVPIIKEPAGCAREDGKRPDGLTLIPWARGKSVVWDFTCSDTFAPSYLPQTSIRPGVAAEKAEDRKKKRYEQLMDSFLFVPIAIETTGIWGKDGLSFIKEIGSRITNITEEKRATSFLLQRMSITVQRGNVASILGSLPKGHKLEEIFML

SEQ ID NO: 2912 - protein, 877 aa, synthetic construct
  source 1..877: note = Description of Artificial Sequence: Synthetic polypeptide
MRRDRDFSTSSVLCFTETWLCGSIPDSALQLAGFQLLRADRDTELSGKTKGGGICFYFNNSWCNDVTVILQHCSPDLETFFINCKPFYSPREFASFILVGVYMPPAGNVHEAQRTLADQIRRVERTNPDSLVIVLGDFNKGNLTHELPKYRQFIKCPTREENTLDHCYTTVSRAYHAVPRAALGHSDHVMVHLIPAYRQKLKLCKPAVREFKKWTSEALEDLRACFDCTDWDVFRTATDSLDEFTEAVTSYIGFCEDSCVPSCTRVSYNNDKPWFTAELRTLRLQKDQAFRSGDKDLYTEAKYKFSKAVRDAKRLYSEKLQQQFSASDSASVWRGLKHLTNYKPKTPHSMNDLRLADELNEFYCRFERQCPDPIPHSSTNLLQSPSPPSPSPSGAHASSSISPSPPPPATTLSILERDVNRLFRRLNPRKAAGPDSVSPHSLKHCADQLSPVFTDIFNTSLETCHVPACFKASTIIPVPKKPRITGLNDYRPVALTSVVMKSFERLVLTHLKSLTDPLLDPLQFAYRANRSVDDAVNMALHYILQHLDSPGTYARILFVDFSSAFNTIIPSLLQDKLSQLHVPDSTCKWITDFLSDRKQHVKLGKHVSASRTISTGSPQGCVLSPLLFSLYTNSCTSSHQSVKLLKFADDTTLIGLISGGDESAYRWESDHLVSWCSQNNLELNALKTVEMVVDFRRNRAPPSPITLCDSPVTIVDSFRFLGSIITQDLKWELNISSITKKAQQRLFFLRQLKKFNLPKTMMVHFYTAIIESILCSSITVWYAAATAKDKGRLQRVIRSAERVIGCNLPSLQDLFASRSLKRAKKIAADPSHPGQKLFVPLPSGRRLRSIRTKTSRHTNSFFPSAVGLINRARSPTA

SEQ ID NO: 2913 - protein, 1060 aa, synthetic construct
  source 1..1060: note = Description of Artificial Sequence: Synthetic polypeptide
MKKRKREGVTRPGGSPGPPFGARPRWRARQRASGGRVYRGARPGTARRSDAAAQHSTPHGLTTCGGNRWGRVRCYKGGSDSGGSRRNRPGRQMLALGTWNVTSLGGKEPELVREVERYQLDLVGLTSTHSLGSGTKLLDRGWTLFYSGVAHGVRRQAGVGILISPRLSAATLEFTPVDKRVASLRLRVVGGKTLTVVCAYAPNSSSEYSAFLETLNGVLHGAPVGDSIVLLGDFNAHVGDDGDNWRGVIGRNGLPDLNPSGCLLLDFCASHGLSITNTMFEHKDVHKCTWYQSTLGQRSMIDFVIVSSDLRPHVLDTRVKRGAELSTDHHLVVSWVRGWGKTRDRPGKPKRVVRVNWERLEEAPVQKIFNSHLRRSFSHIPVEVGDIEPEWSMFKTSIAEAAAVSCGLKVLGASRGGNPRTPWWTPVVREAVRLKKEAFRVMISGGTPEAVAVYRQARRAAASAVMEAKQRVWEEFGVTMEKDFRSAPKCFWKTIRHLRRGKRGTIQAVYSKDGTLLTATEEVIGRWKEHFEELLNPTTTPSLVEAELEAEEGSSSISLVEVTEVVKQLRSGKAPGIDEIRPEMLKAMGVGGLSWMTRLFNIAWKSGTVPKEWQIGVVVPLFKKGDQRVCANYRGITLLSLPGKVYSKVLERRVRPIVEPRIEEEQCGFRPGRGTTDQLFTLSRIIEGAWEYAQPVYMCFVDLEKAYDRVPREILWEVLREYGVRGSLLGAIQSLYAQSESCVRVLGSKSKAFPVGVGLRQGCALSPILFVVFMDRISRRSRGEEGLQFGGLRISSLLFADDVVLMASSVCDLQLSLERFAVECEAVGMRISTSKSEAMVLSRKPMDCLLQVGNVSLPQVKEFKYLGVLFTSEGKMECEFGRRIGAAGAVLHSLYRTVVTKRELSRKAKLSIYRSIFVPTLTYGHEGWVMTERTRSRVQAAEMGFLRRVAGVSLRDRVRSSAIREELGVEPLLLCVERSQLRWFGHLVRMPPGRLPREVFQARPAGKRPRGRPRTRWRDYISALAWERLGIPQSELVDVAREREVWGPLLELLPPRPDPG

SEQ ID NO: 2914 - protein, 962 aa, synthetic construct
  source 1..962: note = Description of Artificial Sequence: Synthetic polypeptide
  VARIANT 3: note = Any amino acid
  VARIANT 6: note = Any amino acid
  VARIANT 9: note = Any amino acid
  VARIANT 10: note = Any amino acid
  VARIANT 19: note = Any amino acid
  VARIANT 34: note = Any amino acid
  VARIANT 43: note = Any amino acid
  VARIANT 59: note = Any amino acid
  VARIANT 86: note = Any amino acid
  VARIANT 147: note = Any amino acid
  VARIANT 192: note = Any amino acid
LDXRHXGIXXVQEGSYWKXGGVALYVKEHYTSLXVKIGCKEGXLETLWVKIRGERREEXLIVGVYYRPLTKNSLENWQRLHGIMGXFNYPDISWDEYSARSDRSQSFLTCIEELYLTQEVYEPTRGKALLDLVLAKGDDLVSNLRIXGKLGNSDHEMITFSIHCKPGKSASRVEIPDFRKADFHKLRRLVGXGLRSNEEGNTRRVVFPQGSNPKSSKKVYSLSQERQQKSWETPLAQQGSHGPPEIKARSLQGMEVRNNYQRGVLSSCPHLKSLILGKLISTNSGDWLVRDYGPMRKGIQEEWSFLKEAILKAQRKSIPSHKKGSKRAGRPPWLNREVMDLLKLKREAYKGWKSGTTTKEEYSAAARTCREQIRTAKALTEHKLATRIKDNKKSFFRYVGSCKRNKGSIGPLINEMGRLLTDTQDKTELLNEYFMSVFHQSKGISLLDRIQDDHGGGDHPPIVDVDLVGEHLQRLNIYKSAGPDELHPRVLKELADVIAQPMAKLFEDSWHSGEVPEDWKKANVVPIFKKGRREDPGNYRPISLTSIPGKILEKIIKETITHRLTEGSILKGSQHGFIMGRSCQTNLISFYDQVTCHLDRGNEVDVIYLDFKKAFDLVSHDVLMVKLGKCGLDYFMVWWLGNWLCGRTQRVLIDGTESSWQRVTSGIPQGSVLGPVLFNMFINDLDSGITSNLAKFADDTKLWGSVVTLKDRLAIQADLDRLMKWADLNLMSFNTEKCKVLHLGRNNPQHTYRLGSALLASTTTERDLGVMTDNKMNMSHQCDAVAGRANQTLACIHRGILSKAKDVILPLYSALVRPQLEYCVQFWVLHFKKDVEKLKRVQRRATCMIRGLETKTYEERLRDLGLFSLEKRRLRGDLVAAYKYIRGVHQGLGEHLFTKAPQGRTRNNGHKLIEDRFRLDIRKNFFTSRVPRVWNRLPPEVVQSSTLAIFKKRLDAHLAGII

SEQ ID NO: 2915 - protein, 729 aa, synthetic construct
  source 1..729: note = Description of Artificial Sequence: Synthetic polypeptide
LVRGLRVLDPLGDSDHCLLEFTIQRKVAKASSQVVALDFRRANFNELRRIVGEALKTQRGGEPGVQGEWSLLKETILQAQRKVIPRRVKGGRRAYKPPWLTKNIRECLLAKKEAYSQWKGGVITKEDYSAVARGCRGMVRKAKAEMEQGLASRIKDNKKSFFKYIGSRKKAPGNVGPLQDKTGNLVVTPDDKANIFNNFFASVFLSKDQNCHLPAGPPLGPGGGSPGPRVSEDLVRELLEGLDVFKSAGPDDLHPRVLKELAGVIASPLARLYEHSWCSGEVPEDWKRANVVPIFKKGRKEDPGNYRPVSLTSILGKLFEKIILAHIQEGPAGNGMLRGNQHGFISGRSCQTNLVAFYDQVTKSLDAGVAVDIVFLDFRKAFDTVSHPILIRKLGDCGVDTHTVQWVANWLESRTQRVVVDGSFSTWKDVGSGVPQGSVLGPALFNIFISDLDEGVQSTLFKFADDTKMWGDVGTIEGSNRLQLDLDRLQGWAEENRMGFNTDKCKVMHLGRNNRHHTYRLGNSPLVSTEVEKDLGVIIDSKMNMSRQCGEAARKANCTLSCIHRCISSRSKEVILPLYAALVRPQLEYCVQFWAPHFKRDVDSIERVQRRATRMIKGQQGRSYEERLRDLNLFSLQKRRLRGDLVACYKLVRGDQQALGESLFPRAPQGVTRNNGHKLAEGRFKLDIRRRYFTVRAARVWNQLPSEVVQAPTLGVFKRRLDDHLTGVI

SEQ ID NO: 2916 - protein, 666 aa, synthetic construct
  source 1..666: note = Description of Artificial Sequence: Synthetic polypeptide
MGVQDGWSFLKETILRAQRESVPMHTKGGKSAKKPPWLSKGIQECLRAKKEAYIRWKQGAITKEDHTSVARGCRAAVRKAKAEMELGLVTRIKDNKKSFFKYIGSKKAAPGNVGPLQDALGNLVIAANEKADLFNKFFASIFLSRDRDISPTGSTEGLRGGTARPKVRDDVVRELLEGLDVFKSAGPDALHPRVLRELAGVIAGPLARLYEHSWSSGQVPDDWKKANVVPIYKKGRKEDPGNYRPVSLTSVLGKIFEKIIKEHICEGPAGEIMLRGNQHGFIKGRSCQTNLISFYDQVTKSLDEGVGVDVIFLDFKKAFDTVSHPILIKKLGDCGIDAYTVRWVANWLDGRTQRVVVDGSFSTWRDVGSGVPQGSVLGPVLFNIFINDLDEGVESTLSKFADDTKMWGEVGTPEGRDRIQLDLDRLQRWADENRMEFNADKCRVLHLGRRNQQHTYRLGNTLLISTEAERDLGVIVDSRLNMSRQCEEAVSKANRTLSCIHRCITSRSREVILPLYAALVRPQLEYCVQFWAPHFKRDVASIERVQRRATRMIRGQQGRPYEERLEGLNLFSLHKRRLRGDLVAVYKFTRGDQQGIGDALFPRAPHGVTRNNGHKLIESRFRLDIRRHYFMVRVARTWNQLPREVVLAPTLGVFKRRLDRHLTGVI

SEQ ID NO: 2917 - protein, 1318 aa, synthetic construct
  source 1..1318: note = Description of Artificial Sequence: Synthetic polypeptide
MKFMCWNCRGLGNPAKLRELKQLIAANNPDLIFLSETKMSANDFRRVQNKCRMQNGLAVNSEGRSGGLALMWRDGMNVSIQNYSKHHIDSMVKLENNDNIRVTGFYGHANPNLRSSSWDILRRVGESVREEWIVGGDFNAILNDAEKEGGRRGVRAQMNEFKEVMDDLALVDIKPDSGWFTWVNNRRGGVTWGGLIKERIDRFISSVSVAEKFPFISTKVVRQTQSDHDAIILDLWGRKPKAYPTDKRLCFKFDVCWAGDVEAKNVIERAWNRAATDFGEKIERVRLALGPWQRKKYGNLKRDMQKLEKHIDWIIDSVSSEESGRTLKETRRRLDFLYAREESYWAQRSRSIWLREGDRNTRYFHAKATGRLKKNVIEKLQNAEGQWVTNSEDINKVAKDYFVKLFRSNGQNANTQEMGFIKDCVTRETNEWLCMDYTEKEVLQAIKQMDPNKAPGIDGLSGSFFKHHWDIVGKDTISYCLEVLNGNKNISSVNETMIILIPKIKNPCELTNFRPISLCRFVYKIISKVLANRLKAALPSCISQNQSAFVPGRMIHDNVLIAHELLHYLQSSKNGPNKGLVVKLDMSKAYDRVEWNFIENVMKKMGFVDKWIAKIMECVRSVTYTVKCNNTLSDIFVPERGLRQGDPLSPYLFLFCMEAFSRMLIHAQENNTLRGIRASRNGPRINHLFFADDALLFVRNKRSDIECLVTMLDIFSNISGQEINFDKSMILFSPNTPRAQRILFSDLLGMTVVEKLNNYLGLPIPIGKKKTEAFKEITNRMSCRINSWTKRLLSFEGKEVFIKAVLQSIPTYAMSIFLAPKGIIDDIQAMLSRTWWSGKDKGGFWTMIPWKTLCKPKGMGGLGFRDVRLFNLALLGRQVWRLLNNTDSLCFKVLSSKYFPDGNIFHAKKVDKASFTWSSIAKAVEAFQDGFGWQVGNGEKINIWADNWGMEGLNGAAVISNTLNHSEKFVKDLWHLDRRSWDENKVKQAYGQDWGDKICDIPIGDEVQEDKIIWFHNTHGCFTSKSAYSWLLLKEMGCGPHRFFWRALWKLDTLPKVRVFTWRVGHEILPTNGKIASIRPGFNKGCPRCGAEVETLLHALRDCPTSRAVLSIGGWSRSFISKSYDHCIDWLEDLMRVLDKRAMADLMTILWNCWNNRNNFIFRGKEEEAQLIWERASNLSKEFRICNMLHAPLISQNIAEKRWVKPPKGFLKINFDATVGETGIGYGTVIRDEEGFVLGGGGGFKEGRRSVEEAECVAFEQSIDVACKLNIKDHVLFETDHAGLVNRINNLANDVTIIGARLKDCTVAFTFFKSASLI

SEQ ID NO: 2918 - protein, 1164 aa, synthetic construct
  source 1..1164: note = Description of Artificial Sequence: Synthetic polypeptide
  VARIANT 1036: note = Ile or Leu
MQRMSELGAGLGVVAEPYWVPVRSVNWFGSPDGSVAMVANPAAGTPPCVFRENGSSYVAVDWGPITVVGVYLPHHRNKAGLGELAPVKRVLDRIGELVRRCHPRPVVIAGDFNAHSEGWGCSPRQRDPRGEAVIGWAAGLGLLLMNRGSTSTCVRPGGQSVIDLTWATPSAAGLFQEWRVEAEGESLSDHRHIAWALRLPKPARVLARCPGEGNFPLPKRWALNRLDTDRFRAAVLAATWHLDVGPGEWDPSPAEGAGEIVGIVASACDAAMPQSHPRRRRATYWWTEELENLRDSSVQARRRYYRARRRGGDVAGTKEGYLRAREALKAAIVEAKRAAWEQMVSSLDDDPWGRPYKRVMGKIRPWAPPPTESLDRQALEGLLDALFPRAEGGPPEIPTPPLGEGDWDEGLAVSPEELTAARRRLGAKGKAPGPDGIPGRAWALALGEGNLSAATCRVLSGCLREGVFPPEWRRAKLVLLPKEGKAPGSASAYRPICLLDEAGKMLERIVADRLVQHLSSKGPNLHDRQYGFRPGRSTLDAIQCFRDLTRAVVEEEGGVLLAVSLDITNAFNTLPWPEIGRALEHHGVPVYLRRILSAYFGGRDLAFPVEGGVQGRRAMERGVPQGSVLGPLLWDIAFDRVLRTPLPPGCHVVCYADDTLVVAGGRAGGKPASERRRHWHRWWEPSETWVSRWRPKRPRPCSFTAGVGGRRRRPGSSPGGELGGSPPPSGDGIGIGGGNHQRPGSQGGAPKDPGRVLSRQGSGGAAGDPGPRRWRPRPRRADDEISRPDAGQPMELRTPLQGTGPQGAQGRTGCSQPDAHPRGPRLEGSPPVRHGGALDRPVRGAHMGATAGGLPRRKARAAAGPEARANQGDSGVPYRVVHGGDHPGRRPPCGAPRRGEAPPLLEGEGAPRGGEPVGQGPEGSEAPGRGPDPGEVEGLAVRPPGARASDGRGCPPLPVRVAGRRGRGLSFRLAQVLTGHGCFGRYLRRIGKELTTRCHHCPALEDTAHHTLAACPAWAGERRVLAGAVGCREGEXSLPRMVKAMCGSEEAWAAAVSFCEAVMSQKETAEWGRRPHRARGAAPGGRGTRQRARGGAGRGGLPDPRGPGAPSAARARHRSQGGSRGRRAAFPAFPPPSDRTSRDRGERCPGWGWARSPTNPPLPD

SEQ ID NO: 2919 - protein, 1030 aa, synthetic construct
  source 1..1030: note = Description of Artificial Sequence: Synthetic polypeptide
MDSTYRNDFEKISNLFQTNTFNLDNESDPDINYFNEINGSKFECSYFYPDKIKSIFKNNDNRDYFNIIHINIRSLKKNFDNFLNMICQTENFFNVICLTETWCTEEDFKSNSNLHLTGFNTVFLERNVNKRGGGVLFYIKENLAYNIRSDMSVSDDNIEILTVEIINKKSKNILLSCCYRPPTGRTEYLSNYLVHNIIEKTSQEKKKNYILGDFNLDCFQYNEKKYITKFYNHLFETGTIPIINKPTRITKSSSSLIDNVLTNDYFNITLKKGIIKTDVSDHFPIFFCLGADHKTNTNGKITLKKRIYSNNNLNLFKEQLLHQDWSYINFNEDINIIYKSFFNIFYKIYEANFPIREIVLNAKDISCPWITKGIKKSSKIKQKLYIKYLKNKSDKHKNNYTVYKNLFEKLRKKAKQIYYSDLLIKHKHNSRRVWQIMKEITSKHKTNTNTMPNAIKFENKLITDSNEIAAEFNNFFSSIGHNLSNKIPYVDNNSVDEFISSPNSTINFSNLTYNEFEIAFKSLKRNKAIGPDDINGNIVIDSFNEIKDILFKVFKASITQGSFPNSLKIAKVTPIFKTGDHTNITNYRPISVLPVFSKILERIMYNRIYTYLIDNKLLYKNQFGFQRNSSTEHAILQVTRSIADSFKNSQFTLGIFIDLSKAFDTVNHHILIKKLESYGIKDKTLNWFKSYLSNRKQFVYNKESSSQIIKNITCGVPQGSILGPLLFLLYINDLYKASTLTTVNFADDTNLFQSHENIEILFNNMNNELKRISYWFRKNKLSLNTDKTKFILFHPTSKKKRIQNILPDLFIDNTIIKREKFTKFLGVIIDENLSWSQQIDSISMKVAKNIGVLYKARYILNKKQLTQLYYSFIHCHINYANIIWGSAHKTKLKSLYRHQKHAARIINFGNRFSSSTPLLIEMKALNIYELNIFNILCFMFKCKENLSPSVFINLYNLKPKNKYELRDSKNIQEPFCKTKIDQFCISYRGPFLWNKIVLPNFDFSFKWSYSSFKKKTKEIIFSTQNIFIYF

SEQ ID NO: 2920 - protein, 1206 aa, synthetic construct
  source 1..1206: note = Description of Artificial Sequence: Synthetic polypeptide
  VARIANT 239: note = Any amino acid
MVRKEDFEALVSRVLKLEAELQIKDKEINDLKIVVNDMKNQSKLVSNSNDVSNTWSDVVKGRKKNTSVQLDLLNVVVKESHDREIRQKNLVVFGFKTSTNKDESVAKEDDKQELQNLFKQINVKVTIQRVFKLNTKTDKPPPVIVVLTNKEERNAVLKTAKNLRNSPETNNIFINADMTEAERFKMKALREERAKLNEANQDLKYYYGIRNERVVKLLKKLYESTQPYQQISPKKVLYXNLNNITKNPNDRHLLNSNKRLIVYYTNSTSLNNKKNDFRALIDIEKPDVFAVTETWYTPLSDVNIEGYVIYRNDRLNGKKGGGVCIYVNSSIKSYEISNIELKSDLIEQIWTWIEYGQEKVLLGCIYRPPDSSCVTNKNIINSIIAAKRAQDKKQFTSIIITGDFNYNTLKWKDSVEESHSQQAEDFVACLNDCFFEQCVTEATFQSNENELTNILDLVIVDDSNRIFGLSHLPPLGLSSKGHHILKWFYKMKDRIDDFSSSTKKFAYRRGNYEKINVYIKSINWADEFQNKCIDKCYDKFLYHYNQSCKNYIPIVKLKNKASEVWMSNSLRKEIKYKNNYWTTNKKMNWSIAGSKEKYNKMKRNILKQINNSVKNYERNLVNQVKNEPKLLYSYIRKKQKVKNHIRALNDNIGSTMYDKHSIVDIFNKYFHSVYIKEENINDCNFEVQTNSRFGKIFVDQALVKSYLSKLDINKSSGYDEVNPYVLKVCSESFSIPLSIIYQQSLTNSDIPDLWKMANVSPIFKNGSKLQAINYRPVSLTSIPCKVLEKIISDNLKNYLESNNLFCKQQHGFLKGKNCITNLLESLDFLTYQLMIGNSIDILYTDFQKAFDRVPHKRLISKLCGYGIEKEMLNWIETYLSNRKQRVIIGDTKSDWLEVLSGVPQGSVLGPLLFLLYINDLPSKIKNKCELYADDNKIIAVVNNQVDSKSLQDDINNLTEWSDKWMINFNIKKCKIMHFGKHNKNFEYFIKDSKLDSTTNEKDIGLLISNTMKWNQHVNMVVNKANSRLGLLSKSFTYKDKNTMKILYCTFVRPILEYASPIWNPYNKNDIHKLEIVQQRATKLIPELRHLPYEERLKKLQLTSLKIRRLRYDLIQYYKIFHNLDKVCWYQQPKTAISISANGPASNIRGHKARVDIELIKRNRPRENFFTNRVAKWWNKLPEEIISAKSVNIFKDKLDKHMVIMKL

SEQ ID NO: 2921 - protein, 717 aa, synthetic construct
  source 1..717: note = Description of Artificial Sequence: Synthetic polypeptide
MMPIINKSTRITQHSCSAIDNIFTNTLFHSTFKSGIIRSDITDHFPVFAIFKKPKDLQKKDWYFKKRIFTTRAKNMFKLELSTVNWNFVFLETCANNSYDLFLDKFFNLYDKHFPNKIIRIKTKGLLNPWFTKSLLKSSKRKQKLYIRFINSKKERDKHNYLEHKRLYERTKKIARTTYFKNKLLELKGNCKKTWDAIKEILGKQKIHNKALPSVITVDGTQISDVKSVATKFNEFFVNIGPNLASKIKHTPAHFLSYLSKSDKSLAFKKLTSKELDDSIKKLNKNKATGYDAISASVIKDCYELIKDVLLDIFNKSLKTGVFPDKMKVAIITPIFKSGDESLVTNYRPISVLPVFSKILERIMYNRIFAFLYDNNLLYYNQYGFRSNYSTEHALMQLVEVISEASSHNKFTLGIFLDLSKAFDTVNHQILLEKLKYYGISHEYHKWFTSYLTDRKQFISLNDGFQTNKLKISCGVPQGSILGPLLFLIYVNDLYKASNTMSTIMFADDTTLFYSHSNIISLFQVANNELEQISNWLIANSLSLNADKTKFSLFHSKRKFQSIPKSLPMLYINNINIERSFTNKLLGILIDENLSWRDHINHISNKISRSIGILYKTRQILDKSTLTQLYFAFINSYLSYGNIVWGSTNKSKLDCLLKQQNHAARIIHFQNRFTNAKPLLKSMRALDIYELNIFQNYTIYVSTSVKKNAEGFRKYFP

SEQ ID NO: 2922 - protein, 1018 aa, synthetic construct
  source 1..1018: note = Description of Artificial Sequence: Synthetic polypeptide
  VARIANT 348: note = Any amino acid
  VARIANT 617: note = Any amino acid
MENNLSYNINAKNIVFSDNNSDNHTETLLQSEYYSIPESTQYLCENKNKFSILHINIRSMNKNFENFKCLLGELNHDFKIICFTETWLKSNETNSNFELRNYTSVHQMRDICVGGGISIYVHNSIDFIQRKDLNVNNTDCEALCVEIINKLAKNFIINAIYRTPAGSLKTFKTYLRTFLTTKNILQKHVYVVGDINIDLLNHALNSEAKTFIDILLEYNLIPTINKATRVTKKSSTLLDNVITNNFHNSRFKTGIIKTDLTDHFPIFFITESVTLNNATHKSTVFMRQINESSICQFKNLLNNYVDWNLVLQSHDVNNAYDLFLNQFSKMYDKAFPLKVKLINSKSVXSPWMTKGLLKSSRKKQKLYDKYLKNKTYKNETNYKNYKNLFEKTKKQSKVNYYAKLLEKNKGNPQKTWSVIRDLIGKNKIEKNNLPQKLIIEGKMIYHKEVIIEKLNNFFLDVGPNLAAKIPIGQKKFDSYLATTDLIMEEPILTKSELHTAFNSLKKNKSAGIDQINVNVIKSVFDIIEPSLFHIFNLSLKSGHIPDKLKIAKITPIFKSGDETNISNYRPISVLPCFSKLIERIMYNRLYKYLSENKILYNNQYGFKKNHSTDHAIXELVKHISNGFNSDCYTIGVFIDLSKAFDTVNHEILLKKLENYGVKNQSLLWFKSYLTNRKQFILKESKDSKNNLITCGVPQGSILGPLLFLLYINDLYLSSKVLNTILFADDTNLFYSHKDITVLFKIFNEELDKINEWFISNRLSLNVEKTKFILFHKPSKAENIPLKLPNLLINNKIIKRESTTNFLGVLLDEKLSWKFHIKYIEGKISKNIAMLYRTKPFLNNESLKNLYFSFIHSYLSYCNISWGSTNHAKLKKIYSKQKHACRIVFGANRKTQCEPLLRQLGALNIYKLNIHQVMIFMFKAKLGFSPVTFQSYFNEISHKYPTKFSVNNFVVPINFLKLSSYQIQYRGPLVWKEFLPIFSKKQNFVLNCTLQSFKDDSKRHLLNMEFDILDFKYLF

SEQ ID NO: 2923 - protein, 1089 aa, synthetic construct
  source 1..1089: note = Description of Artificial Sequence: Synthetic polypeptide
MKNKTLCIFCFKTVTDNHKAIYCDCCSSWVHAKCNQIDLLTYNLLSEDSSEWYCFNCISKNMPFGLLTDNELLTTLSCKNPQTASSNFLVSPIHSRNILKELNTISGSAINCKFYDVVDFNKAIKPNSDIYLHLNIASLPYHIDDLCSLISTLNIIPMAIGITESNLYLNDTNITDITINGFNIEHCPTEAKKGGALLYLQSNLNYVVRHDLKIYLPKLLESVFVEIIKPHKTNVLIGCIYRHPSMNQNEFNTTFLTPLLEKLSKEQKLIFLMGDFNVDLLSYSESNPTSNYLDTLCSYSFNPSIILPTRITTKSQTLIDNIFMNFYSSDHLSGNLTISISDHTAQFVCVPGTSNQPNKVKISRCLKRCLKKFDPNKFIIEISKINWELIIKKDDNINESINNFLKSFNRVLDQCAPYKTLTKNQIKLKSKPWISKGLLKSISVKNKLYKKFVRCKNINTKNELFTKFKFYRNKISNLLKSSKKSYYITYFNNNINNIKNTWKGIKDIINIKGSLHKTPTQLNLNENIITDHATVSNIFNNYFVSIREKLLNNIMPSEYTYSDFLNFPNANSFFIDPVSEDEVSSLISNTLKNDKSYGPNSIPTFFLKLTSHIISKPLSIMINNSFKNGKFPDVFKVAQVIPIYKAGSLLDFSNYRPISLLSNLSKLFEKAMHNRLYKFLDKFKCLYQHQYGFRSKHSTTLALIEITEKIRRALDNKHFACGVFVDLQKAFDTVDHSILLTKLEYYGIRGIPLKWFTSYLKNRTQFVSINSTKSDLQNCSNGVPQGSVLGPLLFLLFINDLNTSFKFATAYHFADDTNMLLVDKSLKKINKHINHDLGNLVQWLRSNKLSLNSNKTELIIFKSNLAPIKKQLNFRLSGQKIYPLDSIKYLGIKIDSNLSFQGHLNDLAMKLSRSNGMLAKVRHYVNLETLLNIYHAIFGSHLRYACQVWGQSHKQIILRLSHLQNKALKIIYFQYNNSKSNVLYLISKILKISDLVVFLNCLFVWNYHHKNLPLSFNNFFSITNCHYPLRSISSLNLVIPKHQSAKYGNKSIKYQCISSWNKLPPDLKSLNSISEFKIKLFNYLLKKYN

SEQ ID NO: 2924 - protein, 945 aa, synthetic construct
  source 1..945: note = Description of Artificial Sequence: Synthetic polypeptide
  VARIANT 87: note = Any amino acid
MSENSLYNLVSYKMISQPRVNSKGGGVAVYILDKFEFKKNNTFSKTNKHIETLCIEVLNTSGKSFLISSLYRPPCGKQVNFLNILKXFMSQMSKQNKHVFFAGDTNMDALSYEKFANIKNFFNLLFEFNIIPTIFKPTRITNQSSSVIDNILTNCSLNTKFESGLFIADFSDHFPVFHIAREVLSNIDNKKCFVTYRNLSIKKLKKNLNNFKNKLQVEQWDKVYSSTDPNIAFDHFSSTFQNIFDNVCPKITTEIKNKEYKNPWMTITLIKASKRKQKLYVKFLKSKNKEDEKIYKNYKKFFQHSMKEEKIRYFSNQLDKHKFDIKRTWAVINELTGREKKKHTCTCLPQKLISDKKNYNKYNKNMSRIFPIKKIITSTTKICQEFNKYFVNVGPSLASNIVQPNKTFDNFLGEKPTTSINNEKITKLEFNKAIIELKRNKSCGYDGISSNVAIYIMDSISKPLFYLISSSFENSIFPNKLKLAKINPILKKGDCNNVSNYRPISLLPVLSKVFERIIYNRVNNYFTLNNLLYKNQFGFQSKCSTEHAIIKLADKIFKSFDSDELVLGVFVDLSKAFDTVDHSILLSKLKYYGIIGSTFKWIQSYLSNRKQFVLLEKSGALDITCGVPQGSILGPLLFLIYINDMHKASQKISTIMYADDTNLFFNHPBAKTLFETMNIELEKFNLWFIANKLSLNCQKTSFTLFHKKKNNQLISLKKKQSINLPLKLPKLLINKNEIKREKCTKFLGVLFDENLSWRNHIGLLETKMSSVIGVLYKSRPFLDSKSRNMLYFSLVHSQLLYANIVWASTHKTKLLKLQSLQNHACKVINYLNRLVNPAPVMKSMMVLDIEKLNTLQILIFMYKYKNNLLPSVFSDIFLISFSEKYNLRSNTRYNYHLGKIKSHQSNFLITNRGPSIWNHFQNKNIKDLKSISSFKRETKMHLLNS

SEQ ID NO: 2925 - protein, 1087 aa, synthetic construct
  source 1..1087: note = Description of Artificial Sequence: Synthetic polypeptide
MKICHHCKFCNKKIKDNHRAIQCDCCSFWIHAKCIPVDKHAYNMLSNDSSEWFCPNCISNNMPFGVLSDLELKSTLSCKNPSNKIKFHEPPDYLKNLFKTMNNVFNPTTKCKYLDVNELNKSINPGTEIYLHLNISSLPFHINDLSSFVGTINTPPMVIGITESNLYANDSNITDITIQGYNIEHCPTESKKGGALLYLNSNLNYIVRSDLQIYATKFLESIFVEVIYPLKSNTIFGCIYRHPSLNITEFLSIHFNPLLEKLSHEAKNIVLMGDFNIDLLNYRESQVISNYFESLCSHSLFPTIILPTRVTAKTKTLIDNIFMNSFPTDIVSGNLTISISDHMAQFVCIPNNPPIKKKVKMFKRSFKKFDSDSFIQEISDINWELLIKDDDNINESINFFLKTFEKILDRYAPYKELTKKQIKLQSKPWITSGILKSISNKNILYKKFTRSKNVNTKNILFTKFKLYRNKISNLLRYSKKLYYASFFNNNINNVKNTWKGIKEIINIKPSTSTKSFNLKINENVISDHTSVANIFNNYFTTIQDELLKNTVPSKCAFGNFLKIPSINSFFIEPVTENEVANLIKDTLKNNKSLGPNSLPTFLLKLVSHIISKPLCTMMNNSFKNGIFPEAFKVAKVIPIHKMGSYLDYSNYRPISLLSNLSKLFEKAMFQRLEHFLEKHKFIYKHQYGFRNKHSTTHSLIEITEKIRQAIDNKHFACGVFIDIRKAFDTVEHTILLEKLKHYGIRGIPFLWFSSYLCNRTQFVSINGINSGLAKSFNGVPQGSVLGPLLFLIFINDLNVSLKFSTAYHFADDTNLLLINKSLKKLNKNMNHDLANVVQWLRSNKLSLNSKKTEIIIFKSAKTKINKQLNFRLSGQKINPVNSIKYLGIKIDSNLSFASHLQDLALKLSRSNGILAKIRHFVNHETLLNLYHAIFHSHLRYACQVWGQSKQLAFLRLTYLQNKALKLIYFQHTNSNCSILYFLSKVLKLCDLIQLSNCLFVWNQNHNNLPLTFINFFSYRENCKYILRSALNFKLSVPKYRTVHYGYESIQHKSIQTWNNLPSQLKSLKSFSKFKTALFNHFLEKYSL

SEQ ID NO: 2926 - protein, 931 aa, synthetic construct
  source 1..931: note = Description of Artificial Sequence: Synthetic polypeptide
  VARIANT 777: note = Any amino acid
  VARIANT 928: note = Any amino acid
MEGNIESKTFENISFCAYNCQSFKSNSIYISELVKSFDIIFLSEHWLLNIELFVLKNIALPTHKVFFHAAEKKAFGRPFGGNAFIIKKDVLLSPHIIYEDDNILAIKGKNKCHNLVFIGIYLTSCRNNEESLSKYEQQLNLITSIVKNYEDVSECIIAGDFQSYPETLYDSEIRNNKKRNKFSNHLTNFIKSNKLSFIDIISGAGPTYTYQHKTLSNSSYIDHIAALKESSLSFINTSVIPPSPFNFSDHLPIATNIVVTHTNLSTVINSIMHKYNYIPKYAWNNEKFINIYNHNLSVAFNYYTFNEEEIEQELKQTCEKIQNAALLAVKQCFKQQICKYSKSWWTTDLKKCKENLSFNYKQWQKSNYNKTQECIEYKRYIFSRKNFRKAVKAAHNKKIHEKTINIENLRTTNPQRFWDNIRKIKTKATTRLFTINKSQNIKDIVQEFRQHFQTLLNTPLITNNNHNPSQIPPLSKEPNSLIITSADIINCISQLNSNKSPDSCGLSAEHLKNSHNNNLLLWLAKFYNSILSNGKVPNDLSTSTIIPLVKSYKKSLNNPDNYRGISILPIFTKLLEYLILLICPSITDSHSHQFGFKKNSSTLHAEFLLSETVKHYKNNNTPLYMCSLDANKAFDTCNWDLLFEKLYFQKKLPLSVVHTISSLYHSGTANVSYQGVTSNQFSLSQGVRQGSILSPHLYNIYTESILNEIVSECKVGSTINGIYTGVIAYADDVILLSPTISGLQELINRFQTYGVANFIKLNTEKTEFLISGKSYIXNNVIKINGVSIYLQNKLKHLGFQWDNDTSKNKIATLQKTNLNERITQFQSVAKALIDSGIRYCQPSTIVHLYNTLTVPKLIYGLELCKYDTNFLSKIDAVGRAVLKSFFCISKYSKNYLHSFFKIEDISTILLRNKVNLFIRLLKNQTCLXTDN

SEQ ID NO: 2927 - protein, 694 aa, synthetic construct
  source 1..694: note = Description of Artificial Sequence: Synthetic polypeptide
  VARIANT 309: note = Ile or Leu
  VARIANT 529: note = Any amino acid
MIFLRFYIIFLNFNIALSYFLFKMADETVLTNLNFNSFESKKSILLNNYSDPDINFYNNDEVIKNINPLYYNPNSKNIANGMDDNSFSMLHINIRSIQKNFESLKQFLYKIKINFQIICLSETWCHDKNIENNSNFQLPNYKVIHQVRASNKEGGGLCIFIKNSLLYKVKPNLSSTTNDYESLCIEIINETSKNIIIHALYRPPSGSIKVFENHIKKIIKNKSSINKTVYFVGDINLNILDYDKNKNIKNFFNVIFQNSYIPLINKPTRITKESATSIDQIITNEFINKKIKTGIFKTDISDHFPIFIXSQKCIYNAQNKRKKIITTRLINDNSIKHFHNLLSCVNWDTLKLNLNABKAYDIFLTEFLKLYNKAFPEITKFIKTKTLLNPWITKGILKSSKKKQRLYNKFLKKKTLKNETDYKNYKRLFESILKRSKKHYYSEQLIKHKNDSQKTWQIIKEVIGKKNLYRNLLPKNLKFNNKYIVNKSLVAETLNQFFVNIGPTLASKIATTQLNFKSYLTSNNINVMXNYKLTEKELLDAVSLLKPNESLGFDDISSNVIIKSIKYITIPLLHIFNLSLKQGVFPEKLKIAKVIPIFKSGDPSNVANYRPISILPCFSKILERIMYNRLYSFLNINNILYNKQFGFKSGHSTDHAIIHLVHDIFKAFDEKKFTLGVFIDLSKAFDTVDHKILL

SEQ ID NO: 2928 - protein, 1027 aa, synthetic construct
  source 1..1027: note = Description of Artificial Sequence: Synthetic polypeptide
MALISDFETLVFNFFETKFFSLHENSDPDINYFHDTKIECSYYYPNELKGILFKNVNNDQIRILHVNIRSINCNFEKFQNLLEETKYFFNIICLTETWATSNDIKKNFNFYLSHFEMISLERQINKRGGGVLIYIHKDIKHCCRNDLSVSDGDGEILTIEIINERTKNILVSCCYRPPDGVSENLSMFLQQNVIAKGNNEKKKNFLVGDFNMNCFVYNDDNKVKNFYDTIFESGAIPLINRPTRITKNSATLLDNIITTDLFNNDIKLGILKTDISDHFPIFLTINTDQLPKQKLNKIVKKRFYTSSNIEAFKNQLSLLHWKHLNFNENANNLYEKFYETFISVYESNFPIVTITLKTKHFDNPWITKGFKKSSKTKQRLYIKYLKTKTPDSEKIYKDYKNLFEKIRKKLKKNYYSKLINKAKNDSKRTWQILKEITGKQKTCSSSLPQMLKVDNNSLHEPQIIAHEFNKYFTEIGSILSSKIQKTQTSFYDFLLPFDKNISSEELSAELSFDEFEKAFKSLKKNKAPGADEINGNIVIDCYEQLKNILFKIFRASIHQGIFPERLKLARVTPLHKEGDRSNINNYRPISVLSIFSKILERIIFNRVYNYFNYNNLLYNNQYGFRKGSSTEHAIIQFIHNISKSFEKSQYTLGVFIDLSKAFDTVDHHILIQKIKYYGLNNKILKWFESYLTNRKQLVYSNDGYQSEPLSITCGVPQGSILGPLLFLIYVNDLNKASKLKSIMFADDTNLFLSHTDIYELFSTTNKELKHISNWFKANKLTLNINKTKWIIFHSCAKKRFLTNNMPQIYIDETIIKRDTVIKFLGVYLDENITWRKHIDHISTKVSKNIGILYKARNYLNKKNLTQLYYSFIHNYINYAIIAWGSTEKSKLQHLYRRQKHAIRVVNYADRFSRSKYFFDYMNVLDVYKLNIFNVLCFTFMWKNDLSLFVFNDLFSLKPINKYTLRSNSFLNEPFCKTKFNQFCIAYRAPHLWNKIVLPNFDPSTTLPVFKTKLKNFILCMDNILKFY

SEQ ID NO: 2929 - protein, 879 aa, synthetic construct
  source 1..879: note = Description of Artificial Sequence: Synthetic polypeptide
  VARIANT 82: note = Any amino acid
  VARIANT 133: note = Ile or Leu
  VARIANT 139: note = Any amino acid
  VARIANT 141: note = Any amino acid
  VARIANT 292: note = Any amino acid
  VARIANT 741: note = Any amino acid
  VARIANT 804: note = Any amino acid
MDSNEPVNFESTLFNFFQTNDFLLDSDSDPDLNYFSEAGALQNKCSYFYNHEIKEFLDRDNFNVIHINIRSLKKNFENFRNXIEETFNIFSIICLTETWCDSDDVNFNSNFHLPGFNLISLARKTNKRGGGVXIYVKEXLXFFTRLDMSISDGDKEVLTIEILTKKTKNIIISCCYRPPSGVIESFNSFLRNDIIKKSNHEKKFNYLIGDLNLNCFEYHVNNNIKRFYNDIFENGAIPLINKPTRITQSTSSLIDNIITTDVFNESLKKGIIKSDISDHFPIFFSINTNNEXVTKTHSLCLKTIKFNDKFLYDKKEIANELNKYFVSVGPNLAKKIPKAINPINNLFIPNTSQFNSFELSFEEFESAFKMLKPDKAVGPDDINGNIVINSYDIIKDILFKIFSCSIKQGIFPDQLKIAKVIPIFKGGDLTNVSNYRPISILSVFSKVLERISYNKIYNHLSVNNLLYSNQYGFKKNNSTEHAILQFTRSITDSFENSQFTLGVFIDLAKAFDTIDHKILFKKLKYYGITGNVLNWLKSYLNNRKQFVYVDVVSPVNLFDITCGVPQGSILGPLLFLIYVNDLHKASNLMTIMFADDTNLFLSHNNITTLFQNMNIELVKISDWFKLNKLSLNIDKTKWIFFHPNRKKHLLPSEMPLLFIDNILIKRVTVTNFLGIYIDENLSWKNHIENLCSKISKSIGILYKARSVLNKHTLIQLYYSFIHCHINYANIAWGSTNKSKLXPLYRQQKHVARLINFKDRFTHAKPLLFEMKVFNIYELNIFNVLCFMFKCKTNISPVSFHNLYXKKEKNKYILRNDNFIRQPVFQTNFGKFCISFRGAFLWNKIVLKNFKDFSQECNYRSFKQKLKKVIFSIDDISIYF

SEQ ID NO: 2930 - protein, 1254 aa, synthetic construct
  source 1..1254: note = Description of Artificial Sequence: Synthetic polypeptide
MVNLQLGDFNTYKCEQEAIIVDLKKLIETLRTDNANLTKRVLDLENSKSKSSSAVTGDWASKVKKTPDQMQIINTIANETKERDKRENNLVIFGLEESTLSDKVKAIEEDKQNIETIMKKLKVNVKIKNVIKLKSKNGYKAPYIVVLNDKLERNSVLKNAKELKKDKTYESVFINPDLTESERYKSKLLREECKKLNNDNINKANFYFGIRNDKVVKIKKQLNAKKDLNHIRCFNYETNNKINLFSGGGQNLNKLLSNKRQLDIEIVNFHERKKCDLSINKEHDTQKCNELMIWYTNATSLNNKIDELRLQCEIYKPDVICVTETWFKAESDVNIISYNIFRSDRKTHGGGVCIYVKQCINQFETNNLQLNNNFIEQIWTCICFKNNKMLIGCIYRPPDISHEYNNYVLLSINAAKMSIYQKEYSDLIITGDFNYNTIDWSDNNCPFSATDNESQTNKFIECLEDCFLFQCVCEPTFQIANYKSTNILDLIITNDKNKIVSITHSAPLGNVKQGHHLLKCCYLMNDYKFSTEHKKSIRLYQKGNYELFSCHFNNVDWENGFKSKSINEMYDLFLYHYNYATNLFIPRINYQNRRNRNKWITPELKHKIRTKNNIWLANKRNGWNEESTKIQYNKLKIRIKNDIKNNIKQFESTLASKFKSNPKLLYKYINEKKSVKTHIRALEIDNGEIINDQFAIATELNKYFHSVYVNDNCTNIIEFHNIPSNLLLNTVLITQNDVQTRLQALDKSKSVGFDFVHPYVLKECSSSISYPLYLIFKKSMETGTLPDMWKKANVMPLFKKGSKLKASNYRPVSLTSIPCKVLERIIADCIMQHLIKNNLLSKKQHGFMKSKSCTTNLLEYLDILTDAFHNRTPVDVLYTDFKKAFDSVSHKKLLSKLLTFGISGKLLTWIVCFLANRKQRVVLGKSVTDWVDVLSGVPQGSVLGPLLFLVFINDLPENFINECRLYADDNKIIAPISSQNDSQLFQNDINKLDEWSTKWKLGLNFEKCKIMHFGSNNNEYSYFMNNNNTLMEIEKSKLEKDIGVYISSDLKWAKQVKYAASKANSILSLLNNTFKYKDKDLIKTLYCTYVRPNLEFSIQAWSPYYTKDINELEKVQRRATKMIPELRHLEYKKRLEILGLTTLETRRLRCDLIQQFKIFKGIEIIDIKQNQTMNSICSSGPAANIRGAKHRMKPELVRNCLKRQYFFSNRVVDGWNSLPAEVVQSTTVKSFKLNLQSVDLEAITNKIKTKKAYY

SEQ ID NO: 2931 - protein, 1232 aa, synthetic construct
  source 1..1232: note = Description of Artificial Sequence: Synthetic polypeptide
  VARIANT 581: note = Any amino acid
  VARIANT 989: note = Any amino acid
RWQPKFCIKYYNFNFLPKLKIFIQLTLIKMVRKEDFEALVSRVLKLEAELLTKDKEITQLKILVNDLKNQPSNVLNSSACAWSDVVKGKKSNKAAQLDLVNVVVKESQDRDLRQKNLIVFGFNTSKNKNDDVAREEDILGIQNIFNQINAKATIQRVFKLSIKSDKPPPVIVVLTNKEERNAVLKTAKTLRNLPETNNIFINADLTVAERLKMKALREERAKLNETNKDLQYYYGIRNERVVKLIKRQFISSQQDQLLFSKNLLFKNSNKFIEKNNKRQLINLKNQELFNHPKNNYCGKWALTNIRSLGNKIADFQHFVHLHSLDICCVIETWLNKNLPDSLLCPRFYTVLRCDRSSKGGGIAIFFRSFIQFTKVDIPPEFHELEIVCADLNLNGQSFRVIGYYRSGGFGKVAIDYMQSSVKCFSILCSTKKNVVILGDFNLPDIDWHYYHGPDSVIHNSFLHFINRYSLTQHVDQPTRENSILDLILSSSSSFISNLCIEPPIGTSDHNVIIFTPNLSCLYNKTEVPVQQFFCWKNADYQVINKYLKSVDWSIIFQTCFNIEACWHTFSTILNNIITQHXPKVRVCEEHKLSHKIHYPYYVKRLINNKAMAWKRSKVTGKSNDKAAYKSIAAQCSDSIRKYHAAKELKMIRKDNLGSFFNFVNGKLKTCSKLNDIRRSDNTLCHDKEEISCIFNNFFASVFTVDNGLSPKFTDRVNVHSTCLSSINFSPSTVEKALRALKPTTSTGLDGIPNVFLKNCANSLSIPLSHLFDTSFKDGAIPLDWKVASVIPIHKKGPTVDPGNYRPISLTSTCCRVMERIINNKLINYLLLNNLITKEQHGFIRKRSTCTNILESLHDWTLNLQRRIPTDIIYFDFKKAFDSVSHPKLLMKLPAYGIVGNLLNWLTNFLHMRSQVVNLNNVTSHAISVTSGVPQGSVLGPTLFLLFINDVSHINKQLDVKLKLFADDIKLYSVYDVRGLQSDLHTAVNXLYEWSCTWQLQIATEKSFVCTIANQSQNIAQRVYTINNHELAHVNCIRDLGVTIDRNLKFNQHINLIVHKAMSRAFLILKSFYSRDRLLMVKAYCTYVRPMLEYCSSVWSPYTICLINKVEKVQRFFTKRIAGLWSVSYDKRLAILKLNTLEYRRVFKDLVLCYKILNGKLDTDLSNILILNSYLNNRGHNFKLYKHHCSLNSTKCFFSNRIVNVWNSLSEDVVSASSVLMFKKRLAVLLCSS

SEQ ID NO: 2932 - protein, 577 aa, synthetic construct
  source 1..577: note = Description of Artificial Sequence: Synthetic polypeptide
  VARIANT 39: note = Any amino acid
  VARIANT 66: note = Ile or Leu
  VARIANT 248: note = Ile or Leu
  VARIANT 311: note = Any amino acid
MLKKEISESEIKQALGQMKNNKSPGSDGLTIEFYKHFFXLIKKDLIESLNNVLFTGEMTNSQKEAXITCIFKKGNKNDIGNWRPISLTNVDYKILTKVLANRLKDVLPNIIHSNQTACIKNRTIYYNLSYTRDIISIAKKSKLDACILSIDQVKAFDRVDRAFLFDSLKHFGFGKIFISFIKTIYNNINAKVKINGLLSEKIDILRGVRQGCPLSMILYIIQAEIFSCYVRQNKNIKGIHVKESETKXQQYADDTNFFLIGDDSIREVGKALKLNQKATGAKINIAKCQGIWLGKNIFKDKSEYLNFNWDXNTFKSLGIFFSNNANFQYETHWKERFNKMENSMRKWEKYKLSIKGRKTIINSLIIPQALHLAFIAPLPSNGILNKIEAKINNFYWGGKICRLNKTKTQQKINEGGAGVNSLTNKLKAIQLQWISKLYNESICGPWKDAMVYILNLYRNANQSKHTFETIPTQMKLLPPFYSQLLVNWHSLKQKHVLPITKIEEILNQPLFFNSMIKTMPNKFLTPSETHIKNDIILVADITKTFQPGFLHHKSIGLTEKELEFLTKALPRKWYKKF

SEQ ID NO: 2933 - protein, 1155 aa, synthetic construct
  source 1..1155: note = Description of Artificial Sequence: Synthetic polypeptide
  VARIANT 394: note = Ile or Leu
  VARIANT 434: note = Any amino acid
  VARIANT 444: note = Any amino acid
  VARIANT 467: note = Any amino acid
  VARIANT 487: note = Any amino acid
  VARIANT 525: note = Any amino acid
  VARIANT 576: note = Any amino acid
  VARIANT 593: note = Any amino acid
  VARIANT 751: note = Any amino acid
  VARIANT 796: note = Any amino acid
  VARIANT 970: note = Any amino acid
  VARIANT 982: note = Any amino acid
  VARIANT 1078: note = Any amino acid
  VARIANT 1117: note = Any amino acid
MKVKKIFEDILSVKNVQIERAHRTGNKKLKMPRTIVIKLLDFRDKVAILSKSSKLKGKNIYINEDFCFETTQIRKNLREKMKIERAAGKFAFISYDKLIIRDWVAKKSKNLSSTVLKMEENVIFKSSNENDIIGDNDTDSNYFNHKMLESQYYSVSESSQYLGQTKNTFSILNINIRSLNKNFENLKILLDEIKHDFKIICLTETWCKCGETNYEFELVNYTSIHQPREVNAGGGVSIFIHNSVNYILRNDLCVNETDYESLCVELVNNKEKNIIINTTYRPPSGNLKKFKTHLKTFLNKITNSRKHIYLVGDFNINLINYASNNNAKNFINTLLQYNFIPTINKSTRITNRSSTLLDNIITNNFHNNPLYTGIIQTDLSDHFPTFLATNNILXNNISTKSTIFRRQINENSLKQFKNCLKNCVDWNLILQSNXANNAYDLFLXQFCEQYEIAFPEIKKVINTKSLXNPWMSKGLLKSSKKKEKLYXKYLKKKTYKNEITYKNYKNIFEKTKKRSKKLFYDQLLXKTNGNTKKTWNLIKDIIGKNKRKKNNLPKNLLIDGELVYDKSIIAEELNNXFLNIGPNLAAKIPTNSXPFDSYLKTYDKLMDETNLKPSELRTAFSSLKSKKSEGFDKISVDVVKSVFDIIEPSLFHVFDLSLKSGIVPDKLKIARITPIFKSGDKSNILNYRPISVLPCFSKLLERIMYNRLYNYLTENNMLYCKQFGFKKKQFNLRTICCIVNNLVLKKNNSTXHAVVELFNQISNAFNNDCFTLGVFVDLSKAFDTVNHDILIKKLEXYGVKNKNLLWFEDYPTNRKQFLYYNQNNTIKHSITCGVPQGSILGPLLFILYINDLYLASNLLBLILFADDSNLFYSHRDIKALFKIVNEELCKVNEWFISNKLSLNVEKTKFMLFHKPNKSENIPLKLPDLIINKTYIKRESNINFLGVILDENLSWNSHINSIEKKISKNIXMMYKAKPFLNIXSLKKLYFSFIHSYLSYCNIAWASTNYTKLKKLYSKQKHACRIVFGANRNVPCEPLLSELGALNVYKLNIHQVLLFMFKTKNELSPKIFQSYFNEIXHKYPTKFSDNNFVVPKYNLKLTSYSIQYRGPYLWKKFPXIVNKKKTLRDISLEQFKNESKRLLLFMDLNKFDFKCFF

SEQ ID NO: 2934 - protein, 1246 aa, synthetic construct
  source 1..1246: note = Description of Artificial Sequence: Synthetic polypeptide
MTNLTPAQLKQVEDAIKKLIHAETAKWSAKISELEQVIKQQQLIIDKLIQNPNELTNTTTSSIESSWVTVASKNIKKKQPIEQLKIINTFAIEQQQKKKREKNVIIYGIKESAKLSVADKHIDDKETVQNILVTISSDAKPKSVKRIKSTSSKPGPIIVELSDVSERNPLLTAAKKLKNSDNYKNIFISPDLTEAERYLNYQLRMKRNELNSNINLKTSPFRYGIRSSGVVKLKNIQTTTKHRPLDTVYEAAESSNSKIYKPLHKHYYPSSTLLPANLKYKSKNLHNKKTNYSVNCYYTNATSLDNKMADLISISRTFDYHVIAISETWFRNDSVPNIDGYSLYRKDRQDGRRGGGVAIYITDVFNSHEVNQFYTNLLEQVWVSVKFNNKHILIGCIYRPNDASLIKYVAESFKLAHSLIKKPYDDCLIVGDFNFPNIKWSNDGIESFNPNNPTEYDFWNIFQNSLFTQHITFPTFQTDYGSSNNMLDLLFTYNSNSILNLSPSTILGNTTKGHFSITWRFLVSELFTESESQSFNYKKGDYDSISNFIASIDWEFLFLHKTADQMFNILISNYRTACTYFIPKINKTKKKYDPWVTPHIKNLIREKKSAWHINCSTKWENSELKIKYNRLNRSVKTEIFKAKKAHEKEIISKSQNNPKIVYKYINKQLKIKDRIRSLKDTSGRIIEALPDIVDLLNSQFKSMFTLESSENFPLLNKSGILSECIYNENLDFSISDIIQELADLKPYKSFGSDGLHPLILKICAKSFAIPLTKIFHKSFNSGVVPTQWKLANISPIYKKKGDKLLAENYRPISLTSVACKIFEKLVKKKILKHINDNKMLSANQHGFLYHKSCVTNLIETFDIISSSIASHQFIDVIYLDFAKAFDSVPHNRLLLKLRSFGINGKLLQWIKSFLVGRKQRVTINNTSSAWVDVLSGVPQGSVLGPLLFILYTNDLAKLTETSEIFADDTKLFSKTLSQSNFVDLQDRLRLVYEWSNTWLLKLNTSKCCVIHYGRNNPHYNYFLQNNQGINQSLRSSTKERDLGVIFTSNLKWSAHIQTVVSKSLQILGMLKKTFTFIDEKMALKLYKVFIRPHLEYGVSIWAPFLKADMALVESVQRKATKWAYSLRHLQYCERLKRLNLPSLEFRRLRCDLIQIFKLIHRFDIVNDKYLPKYINSVSRGHHSKIRREYVLNCLPRYNHLYNRSAKYWNNLPEQITLYSTVLSFKNRLDSWLWKKFGTNIYKTGCL

SEQ ID NO: 2935 - protein, 1239 aa, synthetic construct
  source 1..1239: note = Description of Artificial Sequence: Synthetic polypeptide
NLIKILIANMVNVQSTEFNVYKADQDKLIKSLIKTIDELKNCNLLLTERLNVLEKAKVVPSTSISWASVVSGNMPPKRSTEQLHLMNAVVAEAKEREKRESNVVVFGIEASKKADLLSAREEEKNSILHMMNSINAKIEIKQIIKLKSKSDKESPFVIVLNNRNDRNSFLKAAKSLKNSTEFNKVFINPDLTVAERYKAKLLREECKQKNLENSEPSLFYYGIRNEKVIKISKQSFYNCKNQKYFSHGSLTSLVIPKSLQKNHASSISKQRITAVNNKSIKKVICSKRSNFINSYNHLTTNSFNNFTVYLFNARSLANKLNDFFLYVESNKPALICVCETFFNDKLPNSMVCPKNYSIYRKDRVRIGGGVAIYCRNDVKSAIVSITQTDKDIDIICVDLIFGSSKLRLITCYRPPSYSLDDYIYLESMISIISNLCESVPQFVIVGDFNLPKIDWVNYVSPIEKCHNLFLTLVNNLGMYQYVLEPTRENNILDLVLSNIISLLSNISVECPFSTSDHNSVFFYINTFNYYQPETNSESFYDFKNTDIIAFNSYLSKISWDFDFSFVFTTEEYWNIFSNHLRKGIDRFVPIRTIYHNKKSRSYPKYIYKMLIRKSFLWKRWSITKTTLHKKAFIQYASKCKKAISTHHKNVELKLVKENNLSKFFSYVNKNLNNPKKIYPLKTNSNFTTTNVEIAEVFNKHFGSVFTIDDGILPKINTFVSEHIKMNFVDFSAKIVYQKLKNLKPSTSFGPDGIPNILLKQLAHIICIPLSYIFESSFTSSSLPKQWLQATVSPIFKKGSTSDANNYRPISLTCTSCRVMESIVSSSIADYLNINNLITPNQHGFLSKRSTCTNLLESTNDWNKALDSNLITDVVYIDFQKAFDSVPHPKLLKKLAMYGIIDNLLHWISAFLSNRYQRVLVGNSLSNPTCILSGVPQGSVLGPTLFLLFINDLPSIVKDLNCSLMLYADDIKLYSSFKDADYSHDLAVAIYKVYLWSKKWQLKIANNKCFTHRIAPTSFCKDINYNYQLGDHNLTWSTNPKDLGVTMDSYLNYSNHISNIVRASNIRGYLILKCFKSRDPRVIVKAYTTYIRPILEYCSPVWSPNRTKMNNTVERVQRRFTKRISNLNNVSYSSRLSILGLELLEIRRLKQDMITCYKILNNLVCLNKSSFFLFNNYIYTRGHNFKLRKLKCKLDVRKHSFSLRVVNIWNNLPSDVVNAKNIKSFKIKINSIDFEKYCSG

SEQ ID NO: 2936 - protein, 1290 aa, synthetic construct
  source 1..1290: note = Description of Artificial Sequence: Synthetic polypeptide
  VARIANT 1048: note = Any amino acid
MVNVQSTEFNVFKAEQEKLIKALNRTIEELKNLNLLLSERVKMLENAESVKSSPLLSWASVVSGKTPVKKTVEQLNLINVVTAEKKEREKRENNVIIFGINPSKAIDKSSAIKEDKNSIQEVLNSINLKVEVKQIIKLKSKIDNQPPFVIVLNNKTDRNSILKAAKLLKNSSEFKNVYINPDLTEAERYKAKLLRDECKKNNLENSESLLYYYGIRNDRVVKIAKQLLFNNRKLSHMSHCATELANSSRISCEYLISKSSKPDKIICTKKCRNKPINLNLINGNSNNGCNSNNGCSSNPYSKNSVYLLNARSLANKLHEFFMFTEANKPAIICVCETFFTSKISDSIVCPKDYSIYRKDRIKIGGGVAIYCRNDIKSEQVQITQTDTDIDIVCIDLIFSSHNLRLITCYRPPFYSIADVAYIELMTAFIYNLCHSVSQFVIVGDFNFPKMDWLNYVSPNEKCHILFLNLVNNLGLHQFVQEPTRENNILDLVFSNNISFLSLISVECPFSTSDHNTVHFSININDLDQSNKNIESFYDFVNADIDGFQSYLLNINWDFEFSFLFLQLKIIGTFSPIIFAMVFINLFQLERVILIKKLGLRVFLFVFTVEDYWNVFSNHFCNGIHQFVPIRKSNLNKKIKHYPSFIGKMLNRKAFLWKRWSNTKNITHKKAYNKYASKCKKSLLTYQMRVELKLVKENNISKFFNYVNRKLNNSKSIFPLKDKNNNNKITCSNEEIADVFNKHFGSVFTNDNNYSPFINSYVDDSIGIEDCTISTRSSVLVVTKKSLTCLTNTLAVSLQMITITLHLLIVMLMIQLVLKTVLFPPEAVYKSLKEIKASTSYGPDGIPNILLKKLAHLLCIPLSFIFDASFKSSSLPKQWRQAFVSPVFKKGATADPNNYRPISLTCTCCRVMERMINVYVIKYLGHHNLISLNQHGFLNKRSTSTNLLESANDWNTALDNHQITDVVYIDFQKAFDSVSHTKLLVKLASYNIKGNLLNWISAFLTDRYQQVKVGNSISNSIRIVSGVPQGSVLGPTLFLLYVNDLTAIXNNLDCCVKLYADDIKLYSSYCDMDLSQDLVVALNRLLQWAETWQLTIACSKCFALRIAPPSLCKGIKVNYKLGEYSLAWSSNPKDLGVTMDCNLNYKKHIFNVIHQANSRAYLILKCFKTRDPCILVRAFTTYIRPILEYCSPVWSPHQIGLIKSVESVQQKFTKKIRSLRNLSYHNRLQLLGIESLEVRRLKNDLVTCFKIFRKLVCTDQSMFFAIDNNSHTRGHNYKISKQSCRLDIKKI

SEQ ID NO: 2937 - protein, 1088 aa, synthetic construct
  source 1..1088: note = Description of Artificial Sequence: Synthetic polypeptide
  VARIANT 493: note = Any amino acid
MLIRNLCKFCNKTVVDSHKGILCNYCSSWLHPKCNYINKHTYSLIEKDSTDWYCSDCINKNLPFCSLSDFELSLTLSSQTIPTNNLKSLKSPPHFKKLFNNINKISNKSINCKYYDILELNKVLNNNCNLYLHLNIASLPYHIDGLRSLISSLTTLPIVIGISESRLNINDSSKTDVNINGFTIEHSPTEAKKGGALLYLRSNLNYFIRSDLIVYSPKYLESIFVEIVNPLKQNIIVGSIYRHPSMNSNEFITDHFNPLLERLSLENKQVVLMGDFNMDLLNYNESKVISSYLDTLCSYSFFPSIIQPTRITATSKTLIDNIFLNFQTPDLISGNLTISISDHMAQFICIPCLSPKKTKEVIFRRTFQNFDNKKFIKDISNADWQIQITNNDNVNESLHYFFKTFNKILDQHAPYKKLTAKQIKLKSKPWITNGILKSISIKNKLYKQYIKAKNHNIKIHIFNKFKWYRNNICNLLKLSKKSYYINFFNNNLXNVKNTWKGIKEIINIKPSSFSSKSINLKFNGNTISDSKAVSNIFNNYFVNTQQTLLTKIVSPKCNFSDYLNNPNINSFFIDPVTENEVSNLIKSLQSKKSLGINSIPTFLLKLVSHIISKPLCTMINSSFENGLFPDVFKIAKVIPLYKKGSRTDHTNYRPISLLSNISKIFEKAMHNRLYNFLDKYQCLYKHQYGFRSKHSTTHALIEITEVIRKALDDKLFACGVFVDLQKAFDTVDHSILLSKLEYYGIRGISLQWFTSYLYNRFQFVSINGNTSSLVKCTTGVPQGSVLGPLLFLVFINDLNLSLKYTTSYHFADDTNLLLINKSLKKINKYINHDLSNLIQWLRSNKLSLNTSKTEIIIFKSKQSKISKHLNFRLSGQKINPVMYLKYLGIKIDSNLTFSQHLKDLSIKLCRSNGMLAKIRHYVNLETLINIYHAIFGSHLRYACQVWGQIRTQEILRLSNLQNKALKIIYFQHYQSNSDHLYFLSKILKIDDLVQLLNCHFVFNYKQKCLPSTFTNFFTVRESCRYHLRSANSYNLHVPNHSSVKYGLKSIKYQSVKSWNSLPSPLKSIDSITNFKNCLFNYFLARYYT

SEQ ID NO: 2938 - protein, 1147 aa, synthetic construct
  source 1..1147: note = Description of Artificial Sequence: Synthetic polypeptide
  VARIANT 289: note = Any amino acid
  VARIANT 422: note = Any amino acid
MTSLKRNSNRRNRPCQGEPQLLQILQWNAGGMSQDKKIQIQKILDTYNIDIFTIMESNLTDDKLTYYQFPGYTLHLLPKDRQVASGILTGVKEGLTSHCEIIKSMGSMQDICEIIRLNVWKSQNHFKMYAVYNPPQNRPNFDLLNISHKTIVLGDFNAHSTRWGYKNRNTAGKEIEDILNSSPLELIYSDEDPATYLHYNGTRTTPDLLLVSSDISELTQRKIIDDPGSGHKPVIASITINSKSMTPKMPTKVLWKFKKADWPKFTNLLETELNASPINYNQHPDKLCXNITNIIIKCAKKTIPRGKVKHYRVFWSKNLEELKRKREVLRNTAEQTGKTEDVQAWRRQSAVLRQAILQAKRTTFNSFISNINYQNDSQRTFKFLGNLLNNKKKPKKEPIRLNNKLLTTDSEIANSFARFYSXKQKKNPFVRNSSRDIRKQVTKFDEIKEDTAIPHKVLTEPFSSHELNAAIKQLKCKKSPGEDCIHPEFLIRMGPKAKEILLTLFNKIWETSLVPTQWKVAIVIPILKKGKDPSNFDNYRPISLTSMLAKLMERMVNTRLTWFLETNNILGNEQAGFRPQRSTNQQVATLSQHIKDALDARNTLTAVFIDFKSAYDLVWKENLILKLAKIGIRHNMLNWIKAFIGQRTCKVRYGNDLSKSNLLQTGLPQGAVTSCSLFNVFINDIAELVQTVTGVKCLLYADDLVLWYSAPKKNAQKRTEIALNYALKLLANWCDNNGMVINTSKTAYQTFSLAHHSINPHLMYKDTPLEQTNESTYLGVTFDTKLTWKNHIAKIAERASNRLNVLKRLAGSLWGSARSTLNTTYKMFVQPIMLYCCETLVTASEAILKPLEKTHNQALRLITGGIKSTPIDAMLLVTGNSTIRSSVEEKALTLYEKLLRIPSDTFWSSYENRPRHLKTQVGLIQKAIELKKRLQTTDKPESLSLPQNPLADNEVQFCTQLLGHSMKADTPPDQMRLLALETINANYPADQWLQVFTDGSYVENQANVGAGVYSELFTFFAAAGQNRSAFEGEIEAIKIALGQLCCRDTKFTNAVILSDSQSAIQSIGNREPPKTAEIHECKKLYQLLKEKNKTIVLQWIPGHCGIIGNERADTLAKKGTTILQANIFLHNEDLNQERIQDSKKQRT

SEQ ID NO: 2939 - protein, 937 aa, synthetic construct
  source 1..937: note = Description of Artificial Sequence: Synthetic polypeptide
MECTLYYQNVRGLRTKSSEFLSGVIGNSYTIISLTETWLEDTIPSSQYFPPCYSVFRKDRDYAATRQRYGGGVLTAVDTSLCARRRYDLELYSECVWIEVTCRDGLNFLIGNYYFPPHLSSDVFARHFRDLEGKLDVTKFRVHIYGDFNLPGIDWLANYNLITSDVTSLKASSLFDFIYFNGFEQRNTIQNSAGNVLDLVLVSTPINYISPITDPLTRVDHFHPPFAVSFCFPLRKQALCSYEYLLYSSGDYLNMYKYFQCYDWKPILNNKCADSAAEALTEVVSSAINDFVPKRVSRLNKYPAWFSKELRSCLRRKLHYHRLFKRSGLDKWYAKFSECRALAKWLFKKDESAHLHGLESDMYAKPQNFWKYVPTKKKRNSSVAPMRNSSGYTCDSIEIANMFAEHFKSCFSSASVPDNNATCHGTSDFLSFIPIDEPEIRESIRNMKSKLSAGSDGIPSFIVKGCAELLTPVLLHIFNLSIHSGIFPSIWKRSVVVPIHKAGDPSTVNNYRPVSLLCSFSKVFEMIMHKRLYRHFRHKMNPEQHGFLKGKSVETNLCSFLDYAVPLVCNREQVDVIYFDMTKAFDKVNHSTLLTKLDSYGLCLTYCQWFKSYLTCRTNYVRVSGSMSDYFSSPSGVPQGSNLGPLLFLMFVNDISLCAKNSKVLLYADDIKLFRRVQSHSDCVLLQEDALQISQWCAKNYLPLNEQKTRTMSLTRKRDSLAFSYTIGGSVITRVSVIRDLGIFIDSSLNFNHHVLTICNASFRNLGAISRFTRKFSSPVCLVRLFCCLVRTKLEYASSVWNCINLTASCCIERVQKRFIGIIYDRYFDRTCYYSYEQLLKKLGLCTLLDRRRLRDLMFLHKVVNGAVDSPLLLSTVCFHAPLRSNRFQSPFYPSALNVASPLTRMQLEFNKLDQSAVDIFSDLIVFRHRLESIICT

SEQ ID NO: 2940 - protein, 247 aa, synthetic construct
  source 1..247: note = Description of Artificial Sequence: Synthetic polypeptide
RRGIIFFISYAAPLGGSSADTLRTTALGLVYSTAEYCAPVWMNSAHTRKIDVQLNGTMRIVSGTIRSTPTSWLPILSHIPPADLRRSNALLREYRKITNNPRLPIHHDTPDLERNRLRSRHPTMKTAKELHNTDFNLIESWKERWRQACPEQCQALPCITERPPGYELPRKAWSSLNRIRTNHGRCADSLYRWGKIPSPNCDCGADRQTIRHIIEDCEMRAYDGNVSDFLTAKDAAIDYIRNLDVCI

SEQ ID NO: 2941 - protein, 1040 aa, synthetic construct
  source 1..1040: note = Description of Artificial Sequence: Synthetic polypeptide
  VARIANT 62: note = Any amino acid
  VARIANT 221: note = Any amino acid
  VARIANT 478: note = Any amino acid
  VARIANT 538: note = Any amino acid
  VARIANT 564: note = Any amino acid
  VARIANT 670: note = Any amino acid
  VARIANT 717: note = Any amino acid
MIMKKKQQTPESVLTRELGSTTRICQLNVEGLSSSKSQFLSKFLMENDVDVAVLQETHIENXEQQRSRGKIHGYDLLGAVYHRHYGLATYVRSSIENAALVSLSADCFQQIVTKIGELTVVNIYKPPQTEWPQNVIETHPHPTIYAGDFNSHHTDWKYRTTDINGEKLSNWAEENHLHLVFDAKDKNTFKSAIHNTETNPDLSFTTRNSQSHPIPTRRKIXESFPHSQHRPILLEIGINIPLIRSLPRPRWNLQKANWDKFSNDIDQTLRWIPARWYNYDRFVNIIIAAAKRYIPRGYRKEYIPGWNEETEELHQRFLQENDAEIADKLLRNLDVARRKKWEETTEALNFTKSSRKAWNLLRKLGDASAPEREVPGVSPNQIASRIVSLSRAPRDKKRTTFVKRHLKSFRQSVEAPNKISRPFTVEEVNTAISKIKKGKAPGFDGVLPEFLIHSGRRTREWLSQFFSHIMQTGLVPPXFKKAKIISLNNIFVKPGKPKDKPESYRPISLLSTTYKLLERLILGRIEPILEEHLPVEQXGFRHNRGCEDQVLSLTSHIEAGFQQXLKTTVAFVDLTVAYDTVWKDGLLYKLYRTVPCQKLLRLFNNMLRDRTFQIIMGDKASRVRKINNGLPQGSVLAPALFNLYISDMPETKGRKFGYADDLAIAVQAKXMEDADTLLSQDLEVVGKFYADWRLIVSTSKTETTSFHLTIGKQQNLXKYFSTIKCSPIISSQSILVSHWIAPSPSGNTWKQRQPKSTLAITSCTNCVAAGGEHMLPLFSLNNREATKSPKVLLNNKVLPHNQFPKYLGVTLDRTLSFRKHLEATAAKVNTRNNILHKLCGSRWGAHASTLRGSALALVYSAAEYCSSSWLNSSHVSKLDARLHDTMRTISGCIKSTPVQWLPVLSHIAPPPLRRKGCLVRQLKRIQSDPDLPVHKDIPHLSLRRLKSRKPPLVSAQQLQDADFNITEQWRTDWSTVNFTALWPDPTERPTGSNFPADNGKRLTGSEHLTESVRILCTSGAYRKSSVRLWCFASDNRPYCV

SEQ ID NO: 2942 - protein, 1192 aa, synthetic construct
  source 1..1192: note = Description of Artificial Sequence: Synthetic polypeptide
MRCRSSHPSILQWNCGGFFHHLAELQQLMCHSLLCIAYRKRGFLFRGPLPYVATGAISKIAPSVTGSLEVCASMSLPLSPVRCAPHHESQGLWRCVPLCPCHCPQCAVPLTTNLEAVAVRIRVRQELTICSLYLPPDEVVCLADLVPWSLNFPRRFSFWGILMPTTLCGVGRRPRLVVGMPRALVAQLPPPFLLLGDFNAHHPMWGGTQTSARGRDVEMLLTQRNLCLLNTGAPTHFSVARGTYSAIDLSICSPSLLPHLNWNVHDDLCGSDHFPIFLSLPETQAANRLPHWSLHRADWPAYASAAVVTTPLPAGIEVAVQQVTKAIVSAAEKTVPTASASLRRKSVPWWTQEIAEAIRERRRALQRTGDTLLGHPGTSARASAHRRHPSVENLIAFKRLRARARRLIRQSKKDSWERFVASIGSRASPSRVWTQVRRLFGYRPPTGIPSLTIQGALCTDPQAIAEYMAEHYARCSATETYSADFRTFKERVERKQLSFRTRRQELYNAPFSEWEFETALAACPDTSPGPDRIHSQFLRHLSAEFQHQLLSLFNRIWADGVFPSQWRESTVIPVLKPGADPLVADSYRPISLTNVLCKLLERMVSRRLMWILEDRGLLAPQQGGFRQGRSAIDNLVSLESAIRTAFTRREHLVAVFFDLRKAYDTTWRHHILATLHGWGLRGSLPIFIQNFLSPRSFQVRVGTCLSSPHIQENGVPQGSVLSVPLFLIAINGLAAAVGSSVSSSLFADDFCIYFSSATIGVAERRLQGAIRKAQSWASAHGFHFSGSKTRVMHFCRRRALHLDPELYLGNELLRVEETHRFLGMVFDARLTWQPHLRQLRQKCWKHLNILRCLGHTAWGASRPTLLQLYKALIQSRLDYGSIVYDSAAPSALQVLDPVLHSGVRLATGAFRTSPVTSLLAEAGVPPLRFRRQRLLASYAAHVHALPHHPNYRLLFPDVALPSPRRRPRSGLPIAVRVRSLLSSLESLPIPPTFHYPSRAPPWSVPVRSFGIPSYSPHFSLPFPCSSLVRTRPQLRLDLSRDSKASVAPLNLRRQFQAVLGSFHGAEIVYTDGSLVDGRCGYAYAHDEHIEQHSLPCGSSIFTAELIAIRRALEHLRACPGESYVICSDSLSGLQALDQCFPKHPLVRSIQESVTFLFSLAALWSSFGPRDTLEFRGTNAWIGWLSRQLLQAP

SEQ ID NO: 2943 - protein, 497 aa, synthetic construct
  source 1..497: note = Description of Artificial Sequence: Synthetic polypeptide
  VARIANT 28: note = Any amino acid
  VARIANT 29: note = Any amino acid
TKTWCMMGGFPLTLLFICSQTSNRTVIXXEQAGFRPNRNCIDQVLSLTTFIEAGFQNKEKTSVVFIDLTAAYDTVWRPGVILKLLQAIPSIKINHLINEMLSNRCFQVIMGNNISSPMKLNNGLPQGSVLAPLLFSLYISDMPETKSRKFGYADDWALATRHKDLETTESILTNDLSTIGEYFRKWRLQPSATKTEVSTFHLSNKLANKELTVHFEGKVLRHNRNPKYLGVTLDRTLSYKQHLAKTAAKIKTRNNILQKLCGTSWGSSASTLRTSALGLVYPVAEYCSPAWLNSSHTKLVDAQLNHTMRLITGTIRPTPTFWLPILSHIQPPSLRRKNALVSEYKKLQKNPHLPVHEDIPSIRKARLRSRHPPLETARTLVTNSFNTDDCWRQTWQINATPEQLKMPCISTKPPGFDLPRKDWSALNRIRTNTGRCADLLYKWKKIASPSCDCGAEKQTVYHVVQECPLRAFAGDQTEFLMVTEGSLDYIHGLDISL

SEQ ID NO: 2944 - protein, 738 aa, synthetic construct
  source 1..738: note = Description of Artificial Sequence: Synthetic polypeptide
MMNSRDAAHRRFKASTKPEHYEEYRKLRNKVKQCIRNAKIRYARSFVCSNTNPATLWKNLRSLGVGKATPESVFQISADELNEFFSAPINCQAQINNRPEESPSHITNDDTFHLKHVTINTTRKAIMRISSEAIGNDGISITMIKNVADSLLPVLTDIYLISLSFSANQHIACVSKALEYIVHDQITEHLCKFSLFDKYQSGFRKNHSTNTALIKVTDDLKFAMNNREATILTLLDFSKAFDTVNFDILLNKMRQLKFSNSALKWFESYLKNRQQSVVCGNEKSSWRNVVSGVPQGSVLGPLLFSLYVNDISSVLTFCKYHFYADDLQLYQSTRPEDINTAIAQMNEDLSSVVTWAKNLGLKLNAKKSQVILVAHQKLISSELRDQLPPIQLDGIPIPYQKTVKNLGVIIDEHLNWADNTVTVCRKTSACLYALKKFRNIFPQDVKCKLVQSLVLPNLHYCDMIQHGTSSENTRRLELTMNACVRYICNIRRYDHISASYTQLGWLRPDKLRDYHTLCLLHRLLSEQHHSTSPQNLTIFRAIIILTQDPTYLVPLCPFIKRKHLQTPSLSLLFASGTSCPALFARFSLLLRLRKSNTSLCHPLKTLAKTHVYSQVSLCVIVKPMLFSPLFLFLLFLSPNQCSSLRYFSSSSFFHHNLLFRYISLCEYYYTHFSPPFPPLPPCPLLLAAIIKTFPYCNTCHVSYLSNTNINCVYVLLLLVLIENFNFCRFSITSVILEM

SEQ ID NO: 2945 - protein, 552 aa, synthetic construct
  source 1..552: note = Description of Artificial Sequence: Synthetic polypeptide
PHQNLLRPFTQAEVDLALSKCKNGKAAGLDDIRVEQIKNFGPITKAWLMELMNNCVQSCKIPKLWRKAKVIAIRKPGKDQNDPKSYRPISLLCHLYKLLERLILHRLMEKLEEYTYHTGWLTGEELHISSDETYTAHRRWVSKERDHRSCIYRSDSSLRYCKQKIFLSNFRDKEADGDRKRMDYPRESVLAPALFNIYTNDQPLPEGTQSFIYADDCAITAQAHCFETVEENLSKALREMSAYYRENQLRPNPGKTQTCAFHLKNRQAARTLKITWENTTLEHCTYPKYLGVTLDRALTYKRHCLNTKQKVAARNNVIRKLTGTTWGAHPNTVRTSSLALSYSAGEYASPVWFKSSHAKIVDVALNDTCRIITGCLKPTPLNKLYSLAGIAPPDIRREVAAKSERGKSETSEAHPLYGHQPANQRLKSRKSFLRSTEALVGTSQQCRTELWRARYTGTAGWFTPCEKLPPGYTEKWSTWRSLNRLRSGVTKCKSNLVKWGFLVESPLCECGATQTTSHLLQCTQCPATCTPEDLLHATPNAIQVANFWASKV

SEQ ID NO: 2946 - protein, 689 aa, synthetic construct
  source 1..689: note = Description of Artificial Sequence: Synthetic polypeptide
MIAANVSEFSWDWLDGASWTQSDWEFQSVTARHSAKFERFLGSESDSNLISRRSVINLTEKTYDDAALSVLGKGLNFAPTPKRLPVVDFISSIEQAVSKLPSDSAEEARREACRVLTGARPPKCNITAAEASALRSLRMDPDIVILPADKGNATVLLNKDDYIQKMQCLLSDSAYRRIGADPTKSVERKTNNLLKKSPFSQETIKSLNSYCAVPPRLYGLPKVHKENIPLRPIVSNIGAPTYRVAKHLASLLSPMVGRCEHHIKNSADFLRRLQGLRLNDSDILVSFDVVSLFTRVPLSDSLQLIEVKFGVELTNLFRHVLTSTYFLFNGQYYEQTDGVAMGSPLSPIVANLFMEDFEERALVSATLKPACFFRYVDDTFVVWPHGSENLNGFLEHLNSIHPNIQFTMEVEKNGCLPFLDVLVRRKVDGTLGHSVYRKPTHTDLYLRADSCHHPAQREGVLRTLVHRAHVISDPESLSAELSHLEVTFRQNGYSERQIKRALRYQPSVQRVSDDSNEVAPKSMAFLPYAGSISNKIGRILRKYDVKCVFRPPSKIKALLGSVKDDLGLRKAGVYRIPCSCGMSYIGQTIRTVEDRCIEHKRYTRLQQPNKSAVAEHCLGTGHPMEYNNTEILACTSTYWDSVIKEAVEIKLASDLINRDGGFCLNSAWNPALSLVKKQRDKINAASPVD

SEQ ID NO: 2947 - protein, 469 aa, synthetic construct
  source 1..469: note = Description of Artificial Sequence: Synthetic polypeptide
  VARIANT 73: note = Any amino acid
TYENNSLSKSDKLIGNMIGNRGFQVIMGNISSQKFLQNGLPQGSVLAPLLFSLYIADMPETACTKFGYADDWXIATRHTNFDTMZETLTSDLSALAAYFRKWRLRPNATKTEATCFHLNNRGADRTLEVYFDDTRLNYNKEPSIQHTSVNGGLGLMPRRQKRLASISITEERTELWKYTLTTHASTTTRSQVSRVTLDRTLSFKTHVTKTAAKVRTRNNLIHKLCGTTWGSTATTLRTSALSLVYSAAEYCAPVWLNSSHVKKIDVELNNTMRIISGTIRSTPNIWLPVLSHILPPKMRRETALLREYNKIEANPELPIHSDIPDLRIKRLRSRHPPLSLDSLTGADINSWRREWLQNAPQLATHQLLEKRMAPKRPTTCHLMPCITEAVPGFDQPRKIWSTLNRLRTGHGRCADSLFKWGLLSSPACDCGAPKQTIQHIREECSARAFSGDFEEFLMATQKLLNIYKD

SEQ ID NO: 2948 - protein, 425 aa, synthetic construct
  source 1..425: note = Description of Artificial Sequence: Synthetic polypeptide
HKVSHTYLPITKLFSFQWQGIQTVRWSSYGFPLSPILAEIFMDNFENQFLESNPLSSKVGYWFRYVDDVLCLWTGTTRQLQTFLKQLNSAHKSINFTMEFGGNCINYLDLTIDISNHCHTFKIYRKPSTTDTVIPAQSQHPVTHKHAAFHSMIHRLLSIPMSKESFQIELNTIRQIASNNGYPLPWWLPPTLVDSIMHKKQKQHVSSLLYPVINTPTSQDHSKWCTIPYLGKVSVNVAKKLKSRNFKTSFYTHNTIGHFLPNGKDNPPALEKSGVYKITCNCGKFYIGQSGRAICTRLKEHHRSWKLRQGNSTFADHLLKEGHSYNVTHEVLHHVQKGRKMNFFEIMEINRHMYTSPNLVLNDQTQFPYSPLLSAEPNHNPVQTMPCADNVNYHLLPTCLIPLLLFHSHVIKALCNHNCLAAYQI

SEQ ID NO: 2949 - protein, 1124 aa, synthetic construct
  source 1..1124: note = Description of Artificial Sequence: Synthetic polypeptide
  VARIANT 251: note = Any amino acid
  VARIANT 894: note = Any amino acid
MDSTAPCKKVLAKEILQAIKTASVDTFEKLALPAIGLLPMANEKENVPTVHKEETTMATPPEETCPQPTPTSASEALSPVETPEPSVQEESGGARASQAIPGVSQETVTASTPKGGKRSTADEAVSSVVSKRKTVPPLRLNDFLVECRKIKKPTKICIPLLHKKKYVEMTSRISYPDESEADSLVPPCKEKKLIFLHTNVQSLKNKLFELQYWLEKLNCSILMINEHWLSCGELELSVPNGYELATGYCRXNKAHGGVSIYINKMLQLNYETLDVNEFCIESHFEVAAVLLTELEIIAVSVYRPPNHSEDLFIENLQKLIVSLLKKKKSQSSNFWRHLSHSSRKKNHRVLIFGDINIDIRYRSSTVTNLLDTLRSLNFYCINDKPTRKNACLDNIICNFHIGRDQFNTIKLAISDHDGLWLRLPLSHKTDTSQQRIIRPINEQKLNTLKSKLTLVNWNELLTRDMGANESTKRFLEVVTKIFEETCPAYYKKHSKNRSQSKPGTLKQWYTAELNNLRILMLMYYDRSQHSNIDRLRYKNIKKYYRSAIKEAKCKSNDDYILNSVNKCKAAWEVIKTEINHQKKDQNIPISPDTLNKYFANPLMENNTEEDVNKAEELLPQLHNKAMGHFEWNHVTCRQVSVAISKLSNSRTEDHYGLSNFIIKQISQEILTPITNIINKILTEGVYPDSLKISVIKPVHKKGSTLSPDNYRPISLVPIISKITEYCMHQQLNNYFEHNNLICSEQFGFRPTLSTVKAVDNIITKVYDCFEKKTLSCATLLDLRKAFDMVSHNILIRKLQYYGIGENALRLLQLVNVNNKKSDPLPVKKGVPQGSVLSPFLFIVYINDLPSILPCEAVLYADDTTLIAQNSDMDELLLNVAVAIENCNNWFQANXLHINSSKTENIIFDLNAHKHENKSVKLLGFHIDQSLSWETHTDKLCSKLARVIYLLHRLRGCVSKTLLLYAYFAFFSSHLTYGILLWGNSPGSKAVFKWQKKAIRCVAGLAPQESCRHFFKEMKIMTVPSLYIYSCLVYVKENLHKYDLRMSVHNHNTRHRHAIDKPHVRLAKVHSSYKYLGPTFFNKLPNEAHSVPLNKFKNIISKWLKSKAFYTIKEFEESTIDDLEF

SEQ ID NO: 2950 - protein, 1743 aa, synthetic construct
  source 1..1743: note = Description of Artificial Sequence: Synthetic polypeptide
MSKLRDGSVLIQAETPAQSRSLLTCDHLGDIPVSITPHKSLNRVQGVIYHRDLLLQTDEELRDNLQRRGVHFVRRVFRGPKDNRVATGAFVLAFEGDNLPEKVKVMMYRCDVQPYIPPPMRCFKCWRFGHMSSRCNAAATCRDCGRPSHPDTACAPPPYCVNCGGHHSPCSQDCPALHKERKIVEYKTLDRLTYSEARRKYEKLHPVSLLTSYAAATTMAPPPVATSRPALPPSVGPMGRPSTSASQTSGGTPSSAGPVLPPTSGVVTPAPQPEKGSPSLASSSGKGTCSPLPTMSPQKSDTSQRLKDPRPESRLAPQSSHTPQAPPEKPPSSGRPKERREDKKEKKERRKAQGDAGGLGAPSPCTGHPSRDARRFGLCRSRGCHGHGGSDFTARDECSCHPSSIFIVFMHRQSGDSLILQWNCGGFFCHLAELRQLLSSFPTLCVALQETWFPGDRTPTLRGYRGYFNNRTVYNRVSGGVCLYVHTSVYSSPVPLQTALEAVAVRVRASRDITICSLYLPPDADVAPADLAALIAQLPSPFLLLGDFNAHHPMWGSNVTTGRGRDFELLFNQLDLCILNTGAPTHFSVAHGTFSAIDLSVCSPGLRPLLNWWVHDDLCGSDHFPIFLSLPHHQRHARLPRWSFHRADWAAYTSAAMLDTPLPADATMAVDQIISVVVSAAESAIPSSSALPRRRPVPWWSPEIAAAIRNRRRALQQYRRHPTVDHLVAFKRLRAQTRRLIRQRKQACWEEYVSTIGPRVSSTQIWTKIRRISGYHPPAGVAGLSIRGTIHTDPTIIAEYFAAHFALNSASTAYSQGFCTLKERAERKQLVFRTNRQEPYNAPFTEWEFQSILASCPNTSPGPDRIHCQMLKHLSVNSQRHLLDFFNRLWIEGAYPSQWQESIVIPLLKPGADPLNVDSYRPISLTNVLCKLFERLVSRRLLWVLEYRGLLAPQQGAFRQGRSAIDNLLSLESAIRTAFARRHHLVAIFFDLRKAYDTAWRHHILATLHGWGLRGSLPLFIQNFLLSRRFRVRVGTSFSSPHIQENGVPQGSVLSVPLFLVAINGLVAAVGPSVSCSLYADDFCLYYSTASTSVAERRLQAAIHRAQNWASAHGFTFSPAKTRVMHFCRQRTVHPHPELYLDGELLQVVDTHRFLGLLFDSRLTWLPHLRQLKQRCSRHLDVLRCLSHTVWGAARPILLRLYNALVQSRLDYGSQVYGSASPSALRVLDPVHHTGIRLATGAFRTSPVTSLLAEAGVAPLRYRRNTYSPSMLPESTVPLGIQITDSFSRGRSFVCRRGDPGRDSRRSGAVTSGLREPGLWLSLPICTESSRPSPPYRHPSGHWSLSYEPCHESSRRGWSRPIAIPAQHLLAQYAARVHCTPRHPNNRLLFPGEVIRLPQRRPRSGLPIAARVQSLLSTLDSFPLNRPFRSTFHAPPWTIPRPRIRLDLSREPKTSTSPLVLRHQFYALLREFRNSEVIYTDGSSDGDHTGYAYMHGAYVEQRSLPPGSSVFTAELVAIYRALKHIRTCPGTSFLICSDSLSGLQALDQCYPRHTLVRAIQESILALDDSGRSVTFIWTPGHVGIPGNESVDQLAKQATTCRPLAIGLPEADFRPLLRNKIRELWNAEWSALDVPNKLRTIKDTTSVWKSSQLGSRRDSVALCRLRIGHTRLTHGHLLRREDPPVCQCGAPLTVVHLLLHCPILAPLRHSFNLPNTLSLVLGDDASVANMVLRFLRAGGIYQLL

SEQ ID NO: 2951 - protein, 1125 aa, synthetic construct
  source 1..1125: note = Description of Artificial Sequence: Synthetic polypeptide
  VARIANT 107: note = Any amino acid
  VARIANT 113: note = Any amino acid
LYLKQPQQLHKVGLPIIHSLVKCLKPQEQHQKIALSLQCKTVSTPTTSPGRHPRRSYASALNTAATTPSSPVNTEETATVAVPSEEGGGKSASFSSKFFSRKQSKEXHNITRXKTLKEVSGSSEVTKSISCNKQNKSFHIMYHNVQSLTNKLQELEIILSSDLNADVICITEHWLEKHQIEALKIPGFHLATSFCRTTINMVGQLFLQNRITWWDSYFCKTEFKAMQSYSDLIKEKVFEMSAIELTDKHLVIVTVYRSPDGDIEEFLCKFEMMLNIVEPTKKKIICGDFNVDFLKSSNYKEELLYITKNFSLIPTVNTPTRITKHSKTTPDQIFIQGTFSSYNSKVVKMGYSDHEAVLLTLELYSEKTPPIKMIECRDFSDGNIANFCNQLSQETWYEIFYETDVNKMFNTFHQTYKYYFDIAFPLQQRKLKPAKNKCWITNGIKISSTMKRYLHSYKKQNHLSLEMQHYIKEYNKIYRKVIKEAKKMGNDEYIRKSKNKIQATWNIVRYETDTKPVAKSISLKLENRQVSEATTVANIFNDFFTKIADDLIQSNFQTPNLHHTVNYKSPKGSMFLKQVTGSELMLAMSSLKKLSCGFDDIPDYIIKQTGYHIVEPLMHIINHSFSTGTFPNLLKIAKVTPLHKKGATDDVNNYRPVAQLSGFSKISLKSSFLIDCQLQACSSAQWLLKNIFEKLFLNRLLEFVNKNSLLSKHQHGFRKSRSTTTAIYEYLNSILKAVDEKEMATGIFLDLSKAFDVIDHGILLHKLERKGIRGISNEWIKSYLTNRQQRVVLKQDTTIGNISRRSTYTSEKTTIKYGVPQGSTLGPILFLLYIDDLNDTVLAKQKTLFADDTSILITGIDQKHLQQSTDTSLLELTHWFKINKLIINTEKTVAMNFHLSHQKQQNNHTLKINNRSLKLVDDVKFLGIYLQSDLKWNTHIKALTSKLSSICYMLRILSTSCNKEIVIQAYHTHFQSAIRYGVIFWGNAPCSHSVFKMQKRALRIICNMKKQESCRPLFPSLKILNLPCLYMFETIVFVKEYLGSTSAYQLNSSVHSYRTRNDSNIHVSYARTSAYQKSVIHIGTQLYNHLPGNIKSIKEDSIFKNKLKSFLMDHSFYSVDEYLSD

SEQ ID NO: 2952 - protein, 933 aa, synthetic construct
  source 1..933: note = Description of Artificial Sequence: Synthetic polypeptide
MATLVKNEILRNVDTITPPTEHVIGIKLGELTLYNVYKPPSQKWPVDVLPKANPQQFMLAISTPNIPDGVTRDPQLKALDPPAVYAGDFNSQHTRWGYPRSSAEGIGLNDWADNQDLHLLFDAKDKATFKSKAWGTTSTPDLTFVTRGATGLPVQGTRRVVEAFPRSQHHPVIVEIGLSIPVIKSPPIPRWNLRKADWNKYRCFVEKTINRIPPKPENYKRFTNLLHKAALNAIPRGSRKEYTPCWTKECETLMEEFEKCGDTETADRLINAMNEERRSRWKEAMENLDFTHSSRKSWGLLRKLGGATIPQRPSLGTTASEISAVLKHTSKIQLKTAEKKEVSRDLSNLLVHNPTNMDIVKEVETEEITQALKLMKKGKAAGPDEILPEFLKELGTLGRRWLAKLCTECISTGALPKIWKEAKVIAVLKPGKTGDNPKNYRPISLLCTSYKLFERILLTRLTPYIEANLPTYQAGFRAGRNCCDQVLSLTTYTEKGFQNKMKTGLVLIDLTSAYDTVWIEGLLLKLTRIIKCKQTYTLLKNMLTGRKIKVSLHGTNSKSVVLNNGLPQGSALAPALFNLYIADLPETKSRKFAYADDLAIAYQSKNFNDLNETLNADLKVLNTYYSKWHLHPNPNKTTSTIMHLNNREAHTKLQLTMNGQQIRHENKPKYLGVKLDRTLSYNAHLEDTKQKLKSRNAILSKLAGTTWGCGASTLRTSGLALVYSVAEYCSPVWMRSAHVAKVDVQLRETMRIISGTLRATPCAWLPVLANIEPPEIRRSQLAIRTHQKILGNLDLPIHEDLRATDRLKSRTAFWKTSEELQEFNSKTAWKELWATSAPKNSNLVDDPNKKIEGFSLPRKLWTTLNRVRTGVGRCKQLMKKWGLTDSSECECGETQTMDHLLACEVYGYNGDLKDIHRLSDSALKWLEKICNVV

SEQ ID NO: 2953 - protein, 826 aa, synthetic construct
  source 1..826: note = Description of Artificial Sequence: Synthetic polypeptide
NWNHIPLITTTQRPRWNFRKAKWDIHPEKLDKCLGWIHPTANNDRFMGAVKSAAKAAVPRGFRKQYVRGWDKECENKYQRFLESGDPEIADDLLHSLDNARREKWIETVESLDFKTSSRKAWSLLRKLGGANKLHHNSTDISANRISAHIQATSRAPRDKKHTRTIRRELSFLKKNSTPLDQYSSKFTTTEVREALKSVKAGKAPGLDGVHPEFLLTVGNMPKNGLLNFIQMSQRSAEECQGRKGTWIGWSTPRIPSYCGEYAKKWLAEFYSDVMATGNIPQKMKNSKIIALLKPGKPSNQPKSYRPIALLSVLYKLLERLLYNRLSPKILESIPDEQSGFRPNRSCTDQVLSLTTHIEAGYQKSKKHQLHLSSTFPDNAYRGRLSKKQKTSIAFIDLSAAYDTVWIQGLLYKLIKIIPCSSTIRLINNMLTGRAFQVITGERTSSTKVLNNGLPQGSVLAPLFFNLYISDIPNTQSRKFGYADDWAIAAQHESFEATEDILCSDLKLLCGYFRKWRLQPNPTKTEVSSFHLCNHSARRELNVIFEGKRLSHNNYPKYLGVTLDRTLSYKEHLTNTANKMRTRNNIIHKLCGTTWGSTANTLRTSAVGLVYSVAEYCAPVWINSPHTNRIDVVLNDTMRTISGTIKSTPTVWLPTLSHIPPPEMRRKNALLREYNKITNNPQLPIHSDVADLERRRLKSRRPALLSAKEMMNTNFEVEDLWKQHWQEHCPPKCQSFMTGEKPPGFNQPRKVWTTLNRIRTGHGRSADAFYKWGKTPSPNCDCGAEKQTVRHIVEECPFRAYKGTFNDFLAATEEAINYIKCLDVNL

SEQ ID NO: 2954 - protein, 893 aa, synthetic construct
  source 1..893: note = Description of Artificial Sequence: Synthetic polypeptide
PPPVQISSIHSTHQPNPTKPSKPGPNSLAAPHLHRKILLLCNPKYLHPIPQTDVLALQVLEQHSHTTSKKLSNLFTSYSRLGLPLSTPSTTSRHTPQPLIADKPCLADLLHLPHPQKLPHTTTQNPQPKQTVMNLSSKSLSPIEVSVLSKGLTFCPTPKFNHAGLVKDLLSFSQSLQWKHHFATNPTIQTHTNTNIEPCLTQFTPPSSQDPPTLPPNHPLLTFQNFLTSNLASPSFPKSLKMDTNLTPSERNAIYHLKTDPDLMILPADKGSTTVVLDRKDYVAEGLRQLSDSSTYTPCHNDPIPKTQQDLQSLLKSLGPSQDLSPESISLLTPPTPRTPTFYMLPKVHKPNHPGRPIVAGYGAPTERISALVDQHLQPITHNLPSYIKDTNHFLHRLSTVPVPLPPGTMLVTVDATSLYTNIPNAHGLAAVEHYLSQCPTDCKPTTSFLVTLTNYILTRNYFSFEGITYKQICGTAMGTRMAPSYANLFMGHLEESFLTTQNPKPLIWFRFIDDIFIIWTEGEDTLSTFLQNLNTFSSIHFTWSYSTQRATFLDVDLFLKDGLISTSVHIKPTNHQQYLHFDSCHPFHTKKSLPYSLATRGRRICSDKQSLSKYAKRLTEAFTDRNYPPNLVQKQISRALSVQSPSSSPTPTVRPQRSTPLVTQYHPGLEQLNQVLRQGFDYLSSCPEMRNTLPNILPTPSYSGIPPPTKPTEIPYQISSPPPPTVVFRRPPNLRNILVHPYSIPAPNPLPHGSYPCNRPRCKTCPIHHPTTTYSSPVTGISYPIKGRATCESSHVIYKLSCNHCAAFYVGMTSTQLSIRMNGHRQTVARRQLDHPVAEHAALHSVTHFNDCYTACAIWILPTNTSFSELRRWELSLQYILHSRNPPGLNLR

SEQ ID NO: 2955 - protein, 1088 aa, synthetic construct
  source 1..1088: note = Description of Artificial Sequence: Synthetic polypeptide
MKIIGTAELAEEATLQLNVQVVEDDAPLMAANMVRWYRAAAGTSIELMHRANDASDGSRSKTHGRNQSCFRWIKIEDSWAKPIIVWFFGHDTAMWKGNGKTTTLLYFLNVGRRRIMMAFLGVKYSGDKLLPRSDLRVGSISGGVIKRDEHFNLRIGTWNVRTLQRAGKLENLKREMDKCEVNIMGLSEVRWTDSGEIVSGNYTMFYSGGKSFERGVAIVMGNELVQSLTKVVCHSDRLMFVKISAKPVDILIVQVYMPTSDHEDEEVEKMYDEIEDIIQSEGTGKVNTIIMGDWNSVVGQGNEANIVGQYGSKHSWTIWLGKRNDRGGMLVEFCQRNNLVVMNTWFKKRKSKLYTWKSPGDMNRYQIDYILVKQRFRGSVKDAKTMPAADIDSDHNLLVADISTRMKKIQQHGRRKQRWDLEKLRENNVAVRESLEKKFNEDEIRASAEEQWQNVKMILLNTLKSEVGRETKRARKPWITSEMLEKMEERRKCKNVNERNTEDRNRGTTKKRKVRPHVPENEGTGEGENKSVRTFGIEDSRGQVVTEQVEVLKTWEEYIRELYDTEHRPHDIDIEPEEAIDEDEKGPSILTSEVEKAIKDMKSRKATGDDDIPVDLLKDIGNDSLKALTQVINKIYETGEWPKDFLDVTMVTLEKKKQAKKCSDYRTISLISHVAKIIARLLNRRLEHKIEEVMGEDQFGFRKGKGTRDAIGMMRILSERVLAVNEEICACFIDWQKAFDRVNWNILMNILKEIGINWRDRRLIRNLYLGQRVKVRLKCGETNSVEIGRGVRQGCCLSPSLFNLYGEMLAREALKGCGNFKVGGRLINTIKYADDLVVLAKNQRQLQHMMNRLVEMGRKYGMEINIEKSKVMRISKREKHLKIIVDNRELENVNQFKYLGCFITKDAHCTNEIRARIAMAKAAFNKKRTLLTSKLSLALRKKLVKCYIWSIALYGAETWTMRKKEKKYLESFEMWCWRRIEKIKWTDRVTNDDVLRRVGEKKSILRTILQRKANWIGHILRHEGLIHDVIEGKINGTAGRGRRRIQHLDDLKDGRSYIRLKEEAEDREHWHHKFSVRRHGPATRQNTT

SEQ ID NO: 2956 - protein, 645 aa, synthetic construct
  source 1..645: note = Description of Artificial Sequence: Synthetic polypeptide
  VARIANT 40: note = Any amino acid
  VARIANT 531: note = Any amino acid
EFAGRRKLGVLPQTRGTPLSFLKTDYDQKICQLLEDPAYXLLENDPTDKVDRKTRSLLKETGWPEKVVKQLRAKAPVPPRLYGLPKVHKQDVPLRPIVSNIGAATYATASHLKKMLAPYVGKCVHHIRNSTDFVERLKNLRISNTDIMVSFDVVSLFTRVPLQDTLDLISERFDGTVLDLFKHILTSTYFLCGGQFYEQTEGVAMGSPLSPVVANLFMEKFEEEALTTAAYQPTCFFRYVDDTFVIWPHGQNRLDEFLDHLNSRHPNIKFTMELENEGQLPFLDVLVKRKPDGTLGHSVYRKPTHTDLYLQADSCHHPAQKNGVLRTLVHRAKTLSDSDNLAAELDHLQRVFTNNGYSSRDIRKALHPTRRPDTTGEERRRDREGSLPTICRAYICQDQQNLEETQNQKCFLPTKQDQQSWIISSECSQTTATRAETSARRYTPPDAQIQQEKKEEETGKVAFLPYAGPISAKISRILRKHKIKSVFCPPNKIRALIGGVKDDLGLRKPGIYQIPCECGMSYIGQTTRTVXIRCKEHQRHTRLRQATKSAIAEHCLELDHTMDYDKTRILAQTPRFWDSIITESIEIKMGEDLINREAGYQLSTAWNPALELLQKQRKKGHPPVELQTTTRDSSSGWPPCAPTTA

SEQ ID NO: 2957 - protein, 678 aa, synthetic construct
  source 1..678: note = Description of Artificial Sequence: Synthetic polypeptide
WNKHFARCLVNYRQIRRETSHSIQATKTEHDKSRTQWPSELRNDPLIVVLPADKGNAAVIMERATMTRRFERCWRRRHMQKLSRDPTSKILRKTSELLKRSSLEDSVIKNLLPQAPRPPTLYGLPKVHKMNTPLRPIVSTIGAPTYRLAKHLANLLTPHVGHCEHHIKNTADFISRIKCLRLGEEDMMVSFDVVSLFTNVPVKDCIDLLSQLFDDTVVDLFKHTLTSSYFLYGGEYFNQTDGVAMGSPLAPVMANLFMEHFEDIALDTAPVRPSCFYRYVDDTFVVWPMDVKNSVNSSTTSIASMTRSSSRWRWRKRVPCRSLTSSSAVKQMDVSAMVFTENPPTQTGTCTPQAIIIHRRNSLFHVRCLAHGREKLGEFFDHINSIHDKIKFTMEVEKEGALPFLDVLVSRKANGCLSHGVYRKPTHTDRYLHATSHHHPSQKQSVLRTLVHRAEVVSDTENLQKELSHLRKVFRDNGYSNSQITKAIFPKTQKQKTPEEDSKKLAFLPFCGSVTGKISRLLKRHKIDSVFRAPSKIRQLMRPVKDDVGLRTPGVYKIPCGCGQFYIGQTVRTIEQRCVEHERCYRLRYPEKSAIVEHALENRHRIAFEETSIITRTNSFWDSVIKEAIEIKIADNTLNRDGGLQLSTAWNPAIGRLKRARQARDQNIAFYGHVAEHQ

SEQ ID NO: 2958 - protein, 925 aa, synthetic construct
  source 1..925: note = Description of Artificial Sequence: Synthetic polypeptide
MRIGTWNVRTLLKAGKLEEVKMLMEKSQLDILGICETRWGGNGDFMSGDFRIIHSGSARSGRNGVAIILRGKWKNNVLNTYHCSDRIIMIKIKAQPMDLCVIAVYLPTTNSKDEEVEVVYEQIDDLMKLVKEKDNLIVIGDFNASIGEDKKGLWNGKFGLGKMNSRGERLLDFCEQYEMIVTNTCFEMPKRRRYTWKSPVDGERYQIYILVKKKFINQIKSSHSYPGYDIDSDHVLVIADYNSKFKKYKRTNQHRWCVEKLKEKQVAADMKELTDNLIGNREGWEGFKETVEVAAKELVGLRKLEPRKPWMTKEILDLIEERNRLRKKDFDKYKRVKNAITQKCRLEKEKWMHDKHKEIQQDLSGGQTDKAYSKIKTMQTKTRTKTNMVKNKNGDLLFELEDVCERWKEYIEELYEGEDIANEGEILEEENSVDIDMIGPPISKEEFNSALNDLSNGKATGTDNIPAEILKEIGDQQKSTYINFTFKEYYEDGKEPPTDLLNSKTVIIPKKEMLWTVKQEKTNLVSDLEKAKAILALRMVLERRIGVNRKTYLTFIDLQKAFDMVNLEGQRLIWNLYKRQEAEIEVNGVKKKAKIRRGVRQGCPLSPYLFNLFIEKAIEKLKRITKGIKINGERIHCIRFADDIVVLADSVRKWSLCCLSKEMEFMLLKFAKILREFNLKINKKKTKTMVVGKTKEKGKVNIKLEDDVLEQVENFCYLGSTITDDNKCITDIKRRIAWQSKLSKIKGIYMYHRYKEKNSLAKQAFQNKRNLLTDNHISLESRKKFAKTFVWSVLTYGCEAWTLGKAEKKRLEAMEMWIWRRMTKTSWVDRKSNEQVLREVNENRTLLNYIGRRKSKMIGHIMRHNQFLKNVFEGKVLGKKPRGRPRATYFNNIKEDMGIKSYEELKRMTMERGTWLNRQGIAFSL

SEQ ID NO: 2959 - protein, 584 aa, synthetic construct
  source 1..584: note = Description of Artificial Sequence: Synthetic polypeptide
ASVSRIPEDQADEIRQEVAYKLRRAPPPRSNIPSSERAAIRSLREDKDLVILPADKGNATVLLSRGDYVSKMNLLLDDSAYRRLRNDPTERIKRKTFHFSHGTNKTEDLSLLKKSSLSEDVVKKLHPGAAVPPRLYGLPKVHKHGIPLRPIVSNLGAPTYNLAKYLASVLAPHVGKCEHHILNSSHFIRRLKSVCLGPSDLLVSFDVVSLFTRVPLEESLLLISDKLDDETVKLCRHVLTSTYFLFNDAFFEQTDGVAMGSPLSPIVANLFMEDFEDMALRTSFLKPTCFWRYVDDIFMVWPHGMDALNHFEDGKLPFLDVLVQKNSDGTLGHGVYRKPTHTDLYLHATSCHPPHQRMGVLRTLVKRAYAISDAEHLGEELEHLKVVFKQNGYTAQQICRAFQFGPKGEPLEDNYKSIAFLPFVGNISSKISRILRRFDIKSVFMPPPKTRALLGSVKDDLGLRKPGVYRIPCYCGKTYIGQTIRTVQDRCVEHHRHTRLLQPEKSAVAEHCLNEGHKMLYDETKLIAPASRYWECVLKESMEIRMADNIINRDKGFPLSKTWNPILSDIKQQRSSFRPAVSFN

SEQ ID NO: 2960 - protein, 690 aa, synthetic construct
  source 1..690: note = Description of Artificial Sequence: Synthetic polypeptide
  VARIANT 543: note = Any amino acid
MNKELTSKLHEYLRLFDEDPFSTDTIRSGMTLSQELAKAKQKRWSEMVESMDMSKSSRKAWQLLKRLSNDPTTPKERFNVTPNEVAHQVLLNGKTEGRKEKIRITRHNLETNDLSAKFTLEELKAAIKMCKSGKAPGLDDILVEQIKHFGPVTMGWLLRFYNNCLTRRHIPKIWRRTRIIAILKPGKPASDAKNFRPISLLCHLYKVLERMLLNRLSPVIEPQLIPQQAGFRPKKNCTAQILNLTQNIEDGFERGLITGAVFVDLSAAYDTVQHKIMLHKLYQLTRDYDFTSFIGTLLQNRKFYVELDGKKSRWRIQKSGLPQGSVLAPTLFNIYSNDQPQPPNTKSFIYADDLALVSQAKDFETVERHLTYGLKTLSAYYEKNHLKPNPAKTQVCAFHLRNKDANKKLKVIWNGTELEHCHNPKYLGVTLDRALTFRKHCLNIKQKVSARNNIIRKLTNSGWGAQPTVLRTTAIALCYSAAEYACPVWYTSVHARHVDVALNETCRITTGCLRATPTHKLYNLAGIAPPDIRREVAANIERXKVEQNAAHPLHGHQTPPSRLKSRKSFMKTTVNCSTSPSTARQNLWTTRNADIATWIPPLEALPPGENLPWKTWKSLNRLRSGVGRTKDNMARWNYLGDESTLCECGSEQTTKHLYSCPQCPVSCTLEDLLQAKENAVELANFWSDCI

SEQ ID NO: 2961 - protein, 1547 aa, synthetic construct
  source 1..1547: note = Description of Artificial Sequence: Synthetic polypeptide
  VARIANT 97: note = Any amino acid
  VARIANT 116: note = Any amino acid
  VARIANT 299: note = Any amino acid
  VARIANT 329: note = Any amino acid
MKKRVDGELVKSDSFILTFNSPRLRTMLRQASCVSQTPDHVKAGFLRLNVRPYVPNPMRCFKCQRFGHTTLGCKGRLPVANVVRQPMMGLTVLHLRXVSTVQGTTQSGVGIVQCTXRRRKYRKLRPQGVSPMQRPKRSSRPCNLLYFPPPSLQYCKNQLLKLMPPPRLRLLVWAPTPALASARVRQQKLQLRSPTDNADKATGTAFAEPWFHNCRACHHVTATATTPPTPPPHHSCNHNLCLHHQATLQSLPSRHRHRHNPTNATTSPQLQPQPLSPPPSHLNPRRLPANTVTGKTVIXLSDFVEVIPPEPSSDPAPELMELDLPQGQXSRPNTEPPPRSVSPSRKKERVKIQPPRSNLRDRWPQYCSGTCRVSGRMWRNSVILTQGRPICICLQETNFKSTDNPELRGYVLHKKDDLSGERARGGVAIFTNTAYHSEPLSLTTHLQAVAVSVMCVTVAPLSHHTFTSRCSICYVRHRLTVCSLYLPPHDTFDVAALEDLLTQLPQPFILCGDFNAHNVLWGSASTCPRGRATERLLLSSSAHLLNTGQPTHFCTATGSFSAIDLSLCSPALAHTTQWEVVDDLHGSDHFPIWLHLPDRVEPECRPPQWVISKADWTLFSQLAELETRDNVQEWVDCITQTIHSAAEASMPLSLGQPKRQPVPWWTAECRSAIRARRAALRRFKSRPTADNLAAFRMARAKCRQIIRESRKRSWQQFLSTVTRSTKSSTVWETIRRISGKGGRCPVAAVMGNGVLHTSPRDIAQTMAIYFANVTATAHQDPAFQRHRVVAERGNLDFRSTGHQDYNCPFTLWELDSALSVARDTSPGNDRIHYSMLRHLTQRNKEILLNLFNAIRPGHFPDSWREAILIPLLKPGKDRTCPSSYRSVALTSCVGKTLERMVNRRLVWMLESRQLLSRFQCGFRRYRSTFDNLASLEAAIQQAFLRRHHLLGVFFDIEKAYDTTWRHLILRQLHEWGFRGCLPIFIRSFLSPRYFRYRVGGVLSDRFEQENGVPQGSVLSVTLFAIAINSITSVVKSPVQCSLFVDDFSVFCSSSSLATTTRQLQLTLRRLDEWAQKTGFKFSTEKSVCVLFNRSRSIFNLPELRMRDTVLNFKDTVRFLGLTFDCKLTWLPHLKDLKRRCLKALSILKCLSHTSWGADRTRLLQFYRAFVRSRLDYGCTVYGSARPSYLKMLDVVHHEGIRLATGAFRTSPIPSLCAEAAEPPLSIRRQLLMVRQAYAALSTPYTPAYNTVARPPMERLFRNRLRATRPFGIRAKDCFLDMGVSDFTVLRRGWSRYPPWLLQRPSLLLDLTSFKKDCTPDITFQSEFFNILNKHRDCTVVYTDGSKQGDSVGCSAVFPGHIVGIRLPAAYSVFSAELHAILQALEHIRRARGTKFLLCSDSLSALQSLLVMYPAETITQLIHDQLYLLQRRGKEVSFLWVPGHVGIWGNEAADVAAKAACSDPNVTECAIPLRDVYSVLRQRSLQLWEETWLAVTGNKLRLVKPTVRPWRTSCQPFRRFEVTLTRLRIGHSPLTHSFFIPSGGSTDL

SEQ ID NO: 2962 - protein, 498 aa, synthetic construct
  source 1..498: note = Description of Artificial Sequence: Synthetic polypeptide
  VARIANT 281: note = Any amino acid
RNTNSELRKSELKDPGRYNYLGIVTIGLLQDLPNTCTLLSMHVGHCEHHIKNTADFIDRIKGRRLREEDIMVSFDVVSLFTCVPITDSIDLLAQLFDDTIVDLFKHTLTSSYFLYGGDYFNQTDGVAMGSPLAPVVANLFMEHFEEIALDTAPAKPSCFYRYVDDTFVIWPHGQKKLLLSLRRRYLRHLASWTEKIEEFLEHINSIHGHIKFTMEVEKDGSLPFLDVLVRRKPDGSLGHSVYRKPTHTDRYLHATSYHHPAQKQSVLKTLVHRAETVSDAXNLSNELSHLRKVFKDNGYSKRQISQAVSLKARNQKTSEEEVKKTAFLPFCGSTTGKISRLLKRHKIDTIFRPPAKIRQLMKPVKDDVGLRTPGIYKIPCECGQFYVGQTVRTIEQRRIEHERCFRLRYPEKSAVVEHALENGHRIAFDETSIIKRTNSFWDSVINEAVEIKISENTLNKDGGLQLSTAWDPVIAELKRARRTRDQNIALYGQGTGHQ

SEQ ID NO: 2963 - protein, 581 aa, synthetic construct
  source 1..581: note = Description of Artificial Sequence: Synthetic polypeptide
SPIQSHGFKPRAGGSPGKCAYKQSGCFDGIYPEFLKNAGPKTKRWLLQLYNIILTTGKLPTTFRAAKVIAVRKPGKEGSEASHYRPISLLSVVYKLLERMLLNRIQPLIDKATPLHQAGFRKNRSCCDQVLALTSFIEAGYQRKLKTAVAFVDLTAAFDTVWRHGLLLKFAEAIPCQKLVNLMDSMLSNRRFQVFLGDKGSRWRRLNDGLPQGSVLSPTLFNLYTSDMPNTSAKKIQFADDLALAYQARNLEECEGTLTTDLHIMGDYFKSWRLKPNPTKTEVNAYHLNNREANRKLNVVFENVPLEHNPYPKYLGVILDRALTFKNHLEYVAKKVNTRIDIVRKLAGSGWGANADTLRTATLALVYSTAEYCAPVWKNSAHVRKVDVKLHQAMRIISGTTKSTPLPWLPVLCNIPPPSIRREAAAIREFHKSSTHKNSLLYNQLRNIPTSRLKSRKPPWPMQDSPLVYDVCQEWKDVWKKFPPANSRLITDPTKRVNGFGLPRKLWTSLNRFRTGHGRCSACLYEWGYKDAPACDCGAPVQTMQHLIEECPPRKFPGGLSELHLVTTRAVEWLRDLDVQL

SEQ ID NO: 2964 - protein, 495 aa, synthetic construct
  source 1..495: note = Description of Artificial Sequence: Synthetic polypeptide
MNPQPPKLRSQFKVHKLNHPIRPISNSLNSAYHDLARFLHETLKKSFVFQNNYSVPNSHVLVHKVKDLDCGPDTKLFSLDIKNLYTNVPVVETLKIVEKNLCQFKKLSSEQITDFMNLINVVVKYNYFEFNGKLYQQDDGLAMGNPLAGILADIFINSLEEKFFHKFSTTTLGIVSYSRYVDDILVIYEGPTTGIDHIFTLFNGLHENITFTCELENEARQLNFLDLTLTVEENKISFNIYRKETYTDQIVPASSMHPQCHKNAFFHSAIHRAISIPLSKEKFEEEINLIKTIAVNNEYDPAIVDNILKKKTAKRVTTLGTPIESDQKKKYFSIPFLGPISYQIQRLLRNKYNCNVAFSTNNNLKKNFIHNLKSTCSPLDNSGVYKIVCDTCSSYYIGQTGRAFKIRFKEHLLRKNGTNPQNSSFADHLLITGHAPKAIHDLNILHTEKKGHRLDVLEELQIFKHFSRNDGLILNEQLQLRNRSFFNGIKPLLGL

SEQ ID NO: 2965 - protein, 743 aa, synthetic construct
  source 1..743: note = Description of Artificial Sequence: Synthetic polypeptide
MGNAVVVKVHGSRETQESTRCSPGTTFNQTDIGNHRGMHRLIAAGRLQGGDRSLYGKMEYTRDPEEGKALKTQCFQIEGKGAKPEASGGSTIKEALQETAEEVLGLEERVKRADGTMKIVKRLWKKEMRQGRKGKEENDKQDNKIYYRKFMKKRKEADRICRRKKRELERDGLWSRGMDYGAREEYNDEEVRKFYKKVRELKKGFQPRTLQRRKASNHVLCRDKEGNFIGGEEQVLDQWAKYFSELLNVTTEREDKMSLQKEKTNETEGDQPWQNVSQDERPVPIPTIEEVRKAIKSLRNNKAPGNDNISAEMIKGRGEHLTRLVHQLIVEIWEKEEMPDQWNMAIICPIHKKKDKANCENYRGIALVSVVYKVLAKVIAMRFAPITEEILRRLPVRLSAGQINNRPNFHYKANNGKVLDLHQLQKKYSGDYQCGFRQGRSTTDQIFIIRQIMEKCYEYNVDVHQLFVDFKQAYDSVKRKKLYQTLMEMEFPSKLIRLVQMTLTSTKCQVKIEGKLSKEFEVNQGLRQGDVLSTLLFNIVLERVMRRVEIDNPGGTLFNRMNQNLAYVDDVCMLSRRLKELEEGFDRLEKEAEQLGVNNTKTQYLFASRKNAVVKEKYIKLNRGNYERCEKFQSWGAVTEDSRQIREEIKSRIAAGNRAYWAMIKILQSRSLSRKSKVTVYRTVIRPVVMYGSETWTMTVAEEELLRRWERKILRKIFGAVIEVGQWRIRRNKELEELYRNLT

SEQ ID NO: 2966 - protein, 721 aa, synthetic construct
  source 1..721: note = Description of Artificial Sequence: Synthetic polypeptide
  VARIANT 623: note = Any amino acid
MTIKCKNKMYTLVNAHAPTNIDNKKNPTKVQTFWEELEDTIQKIPKENIIILLGDFNAQLGKERKYKNIIGEYPAHKRTNNNGIRLVELCQVFNLKIMTTHFKKHPKKMKTWKAPNQLLGEFQIDHIAISRREFKTIQNIKVQKGAKIDSDHYLVKSKIKFIPNSVKNNKKPTRKNFETNNIDADTKNIFKSKLQGETWEEMKSQIMKAAEESLPTKIKRKNIWWNDKCNEALDNRQTLWQKFKSNPTQINLERFREGRKIASYTIRNEKRLFEKLSLQQIQVHFTQHKSRDYYQSFKRHLNGYEPPSLNFRDKSGKLGTNDQENCNILAHYFKDLLNCKAPPEKPEFKTTEEIPAESHPPSLDEVRQAIKSLKNNKSSGEDGITAELLKLGEEKVTLHLGTIIKEIWQTEKIPEDWRTALIHPLHKKGDRSDVNNYRGISLLSVPYKVLSKILLNRIEPVLDAQIGEYQGGFRKGRSCSEQIINLKNIIRTRAGQPHVTTFIDFRKAYDSIDRESLIRTLEEFGIDRKTREIVKQTLTDTKSKVKFRGKISDPFKIQTGLRQGDGLSPILFNITLEKIIRETLAEYTQEKVKGISFGGSVKGLTIHALAFADDIALLSTNIXDAIKQIEILAKHAAKFGLQISQEKTKFMSNKFKEVNKLHTIIGCIERVKHFKYLGETITDTGTEKEAVKLRVAKLRRAQILTMKLYNKKCLSRNAKLL

SEQ ID NO: 2967 - protein, 1306 aa, synthetic construct
  source 1..1306: note = Description of Artificial Sequence: Synthetic polypeptide
MNRDCDCCVRMQSELVTLRSQLQAVLTSVAQLEAAIEGRRCCWPVVGTERTPVVSTDRPAPATCPDTASSEADTPPVVAWEVAPVRGRRRKTFRGTDREASPVRLANRFEALSVQDNVPESDGVSHPEVTTQPARSGLSQRWVCLRDGCQGGEEGQRALRVHTGGVIPDVERVLPDAMKGTGCSQLQVVAHVGTNDVCRFGSEEILSGFERLSEVVKTASLACKMKAELTICSIVDRTDCGPLVQSRVEGLNQRLRRFCDRVGCRFLDLRHRVVGFRVPLNRSGVHYTQEAATRVAGAVWRGLGGFLGVRSPLYAGSGYTGSGGCVAWTGRFFRIKSFGEIENGQSQRVQVDHRRNVDPETIGITVVNCRSCVGKVPELQALIESTETHIIIGSESWLKPEISSEEVFSKDLTVFRKDRLNKIGGGVFVAVKSSISCSEVEVDSSCELLWVEVVPENRKKLIIGSFYRPPDSDDTIAERFKENLSLITKTYPTHTIIVGGDFNLPSICWQNYIFKSGGRHKTSSENALNAFSENYFEQLVHEPTRIVNGCENTLDLLATNNPELIMSIKTDTGISEHRAVVAKLNIESPKVTKNKRKVYLFRKADRNKIHCFLKDSFHSFLTLNVGVDQMWLKFKEVVSTAIESFIPNKLIKEGGDPPWYTKQVRTLLQKQRKRHTKFKRTRNPQDWRSYTEARNLARTSMRDAYNTYHNETLSRNLTENPKRFWSYVKYTRGKTQTIPSLRDSNGDPADDSATKAELLNIAFRNSFTKEDETNIPDFELRTEARMSNVEVDIIGVVKQLKSLNKNKSSGPDCIPIRFLSDYAEAIAPYLTAIYNRSLKEGSVPKDWKVAQVTPIFKKGSRSNPLNYRPISLTSICSRVLEHILYSNIMNYLEQNDLLTQGQHGFRKYRSCETQLALYSHEVMSAIDKGSQIDSVFLDFQKAFDTVPHKRLLIKLRGYGISPQICDWIGDFLSERTQFVVIDGKASTKTEVISGVPQGSVIGPLLFLIYINDLGEICYWSSAVPYLHKRFRGNLSSSLRLFADDAVIYRLVKSSEDQNQLQNDLNKISLWCKNWQLTLNNEKCEVVHMSTKRNPLNFVYKINQSKSRPHEYEKKSVKLCLQDKSIKVKAVNSTKYLGITITSDLNWKEHVDNVVGKANQRLRFIGRTLKRCNRTTKETAYTTLVRPFLEYCCPVWDPYQVGLTEDIERVQRRAARFVLSRYRGDSVTEMIQDLGWESLQQRRLSLRRGLLTKLQSPTFSSECENILLTPTYIGRNDHQNKIREIRARTERFRCSFFPRAIREWNGR

SEQ ID NO: 2968 - protein, 983 aa, synthetic construct
  source 1..983: note = Description of Artificial Sequence: Synthetic polypeptide
MMTGFVTKQSGGKIVPNSDLRQGTVSKCVIKDDRRQVRIGTWNIRSLSICGKLENVKKEMEEHDIDILGISEIRWPQKGDFWSGNFRIIYSGKEGSYAGVGIILRKHVGTRVKSYVQYSDRIIMLRIENDPIDTVIIQVYMPTSSHADEEVEQVYEQLEEIMEMVKDKDNLVILGDWNASVGEGEDGNTVGKYGLGRRNDRGQQLVDFCKEKELIIANTWFQQPKRRRYTWIAPGDRARYQIDYIMVRRRYRNQAKQCKSYPGADVATDHNLVMLKSNLRLRRKGQNTKGYCKYDVKKLRQDSVKERYQKQAQQKVKEIPNGTVNEKWIGLKHSILQAADREIGNIKKQATQPWISDHTLELMEERKKFKNSKSEEGIKSYKRLRNMVNREAKKDKEEYIMRRCKEVEEKLEKGNIETAYELIKKQFKKVNGRSNNILDENGKRLFENKEVGERWKRYIEKLYEDPDEISNLENEETVTKDQLGPSLTKEEYLKAVRELKNNKAPGCDALTGEMIQGLDNETHNYIFKLIQDMYETGEIAEDFKKTIIIPIPKKPGTIKCEEHRTLSLISHMSKILTKIIYNRIISKIEQNLDEDQFGFRRNRGTREAILMLRQIMDKMLDLKRPLFIAFVDLEKAFDNVNWNLLMEIVTNVGLDFRDRRIVHELYKNQRGVINIHGEIQEAHIKKGVRQGCNLSPVLFNLYIEEGIKECKESMEGIKINGVQIKMIRFADDIAIIEESEENLQKALSRMNEILPAKYNMKINTKKTEIMVCSHEQITTDIKINDVPLKQVNVFTYLGSKITPDGKSSADIKSRIAQAKLAFNNKRMLLTSRNIKEETKKAFIKCYVWSVALYGSETWTLGVCDKRRLEAFELWCWRRMQKIPWTAKMTNEEVLRRIGEKRALVKTIMKRRDKLIGHLYRHNEFIINVMEGMVEGKRGRGRPRLQYLKQIQRDIGVESYQEMKRLSENREVWRRRIAANQSSD

SEQ ID NO: 2969 - protein, 1308 aa, synthetic construct
  source 1..1308: note = Description of Artificial Sequence: Synthetic polypeptide
  VARIANT 269: note = Any amino acid
  VARIANT 310: note = Any amino acid
  VARIANT 342: note = Any amino acid
MIEEQERLICALQVQLKNAEEELGRLRRGRGAGEWELAVGKKVARRRYSDSFTLQVANRFDQLSELSGDEPPVAVGVGSTQQTSAFGKPKSVERSLRKKKVLLLGSSHGRGVGQQLQEVLGSEYQVTSIVKPSAGLDQVTCNIGDLCRNFSKEDQVVIVGGAGNSLDRDGEYDIGGDLERIATQTGGTNVHFVQLFQRHDRPCLNTAVSRVNMGLEKALMTEGMDHIAVVPVETIQRSDFTRHGLHLNRYGKGRLAKLIGDSVVGGGGXTHGKIPVVVGVRAAPFLDGCTFFRLKTADRYSCLKEVPLRXEPPLTKSKNISNKGITVFHQNIQGIRDKVNEXLIDTDSDIIGISEHFLSGVTIQRLPLPGYRLAAFYSRSSLQCGGVAMYVKKRFFIGVNRFFKNDFSSESIDFSKHCTEQIFECCAGVVNVNGTKLVIVVIYRSPDSDFKMFLPKLELVLGSLYRKYKNLIVCGDFNINCVGDSSRKSQLLDLFNSYNMMQTVFFPTRVQGNSSSTIDNIFVHSSLLEGHSVSRIVNGLSDHDAQLLILKSICSQTNVKHKYQLLRKGKVFVLKQMLNININYSEKVNPVAIETFLSLIKEQEWQDVYSADNADDKYNAFLNTFIMLFESCFPLERSKQGTSSNRQPGWLTKGIRVSCRTKRELYQNVRSSQNEDAVAHYKQYCKVLKNVIKNAKSMWYAKRIANSRDKIKTIWSVVKEVSGQQQQVEDITSVRSRNVSVTDKLDICAIFNNHFLNIVGELNKTLVSTGNHITFLENAFPRLLPEMVLHDTSIGEIESIIKSLKTKDSCGYDGVSSRILKYCSPYVSPVLSHICNFSFQNGQFPDRLKYSVVKPLYKKGERDNVDNYRPISMPSVFSKVIEKAVYSRLIDHFSSHNLLSNVQFGFRSGLTTENAIFSFLCEALDGLNKRLRTLGVFFDLTKAFDCVDHKILLQKLEHYGIRGVAHNWFTSYFNNRQQKVILRSVENGYDVQSQWGTIKCGVPQGSVLGPLLFLIYINDMPSSITGDCKIFLFADDTSLVVKDVARNIDTVSNNAVQEISSWLVENKLMLNHSKTQFLQFLTHNLTKADILITHNGHMISETEQFKFLGVHIDSKLSWKAHVQDLVPKLNSAIFTIRTISEISDFSTRKVVYYAYFHSLMTYGIVFWGNSPDAKRIFLAQKRAVRAISGVSSRTSCRPLFSSLGILTLASQYVFSLMSFVVNNISLFPRVSSFHSVNTRQKSNLHLHHTTLTLVQKGVQYSAASIFNKLPQELKNLSTNPHAFKSKLKSYLMAHSFYSVEELLEKLNN

SEQ ID NO: 2970 - protein, 990 aa, synthetic construct
  source 1..990: note = Description of Artificial Sequence: Synthetic polypeptide
PPSVVPIMAGSPHRILYHNIRSLPANKPLFMHTLSQHCVDAFLLNETFLQPRHSVSTTPYTLHRTDGPPPLARGGVAIGHLRHHPVRPQPPVNNPAEHLILTLFLPSLTVTLATIYIRARVPIPYDFISHIDNSFTTYVIAADLNLHSRSAAELQRWHQFLPTLRGDLVPLPSPTRPESNTTPDAVLVSPNLWDACRRKSLTSLAVTTPPYSSPSTPAAVPAAPPVLCPLLGPLGRLQAEVLDLIGSDHAPVLLTFNPRGRPGRATRPVPPPRLVHDYSRADWDAYRRSINTSVASHPLSLHTPDDIVHASSFLHQTVADAVATHIPTKAIHPHRPPLPPQAVLLLRESRRLYRSFLRTRDRDTLLRHRQLQRHIRNLLNAKKRRDWRQTCTRLNATLPINSSKYWKAFHRLTGSHSVPAYPLLHNNLPLPDNASKAQLFADHLSNIFDLPDNPRFDYSRFPDVHERTDTSVPPLAPGFQYLDHIPPSDLNTPITAQDIVHTLRTKRNTAPGHDRITYRHLRACPPSFHSALASLYNVILFTGFYPDLWKTSRILMFLKPDKPPSEASSYRPICLTSVFSKVLESILSRRIHEHLRLHQLLPLSQCGFRPSFSVDDQLLRLVHLLSVQVNSRRAAILVSLDIEKAYDRVWHSGLLFKLQTYALPINYVRLIASFLSKRPSYVTVNNQNSRLFYPSAGVPQGSVLSPLLYLLYSADMPRPQPPVHLLQYADDTAFLALAPSLARSQHLLQSHLSEFSSWCNQWLLTVNPTKSQAIIIGRTTPSFRHRDLYLTLHGRPIPQTKTLRYLGLTLDRDLSWNPHLKTVRQKALSRLNLLKCLSGRTWGLNPSTILYTYRSLMRPVLCCFHPAWISAPPSYYESLKILERHALRLAYRIRLPSPTRILYDLIPFPHLVQFLQHIRLKYIHRKIESHNPLVSPLLLDPGPLPRLYRHIPPSLHLHTLYVLSEGGFRHLPLPDDVLHNRPDIYPSFQL

SEQ ID NO: 2971 - protein, 561 aa, synthetic construct
  source 1..561: note = Description of Artificial Sequence: Synthetic polypeptide
MIGERKALKELNADNDIVVLPADKGNATIVLNKDDYESKILDLLTSGQYRKLKKDPTASVLKKTNTLIKSSTSIPKEDKKALLKSEAMCPRLYGLPKVHKINIPLRPIVSAINSPTYEIARYLATCLQPYIGKTDSYIKDSSHFIGKLEGLTLRPEDMLVSFDVVSLFTMIPVNEVMTFITDIFPEDLTTLFKHCLTSSQFQWGGDFYEQVDGVAMGNPLGPAIANFYMEKFEQSALGIAKKKPVLWYRYVDDTFVVWPHGKEALDEFFSHLNNINKKIQFTMEMEKDSAISFLDVLVMREVDGKLKHKVFRKATHTDRYLHKNSNHHPQQKRGVIKSLVDRAKKICTPEHLDAELKHLKQAFKKNGYSDKEINRVLRPNNNSLRTRDQTKRWKNTVSLPFIGKVTDQIGKILRKHNIRPVFRPTKKICQVLRSVKDKRPTLSACGVYKIPCTCGKVYIGTTKRSIETRLKEHKSLCRLGKTEKSAVAEHALQSGSHIVRFSETSVLSTMTNYYPRQYREAIEIYKHKENFNRKEEAMKLSDIWTVALKDRQVLSLTDCNR

SEQ ID NO: 2972 - protein, 965 aa, synthetic construct
  source 1..965: note = Description of Artificial Sequence: Synthetic polypeptide
  VARIANT 476: note = Any amino acid
  VARIANT 524: note = Ile or Leu
MPRKNWNCGRRTGDEKRKMMFGCWNVQGISTKIDLLPAELDMFNIDVVVLSETKRKGKGEEELDNYVHIWSGVSKAVRAKAGVSIMIQKKWKKRITNWTFINERIITVEMTLFAREVVIIGVYAPTNDTKDKEKDAFWDTLRETIEKIPRRKELIIMGDMNGRVGIRESCKIVGKHGEAEYNDNGERLIDICAQFDLKITNTFFKHKDIHKYTWQQNTKELRSIIDYIIIRQTSSFKAADVRSYRGAQCGSDHYLVKMKSFWPWKNATNDTSNINKMNCSEKVQNVHFNIDSLQDESIRTFFKARMERTLDESFEGSTEEIYEYIKTKVKNVASEVLGIKENNPKRAAEWWSEEIETSVKEKRNAFVQWLNDKSEGTRSKYKEKKNEVEKKIRLAKNEAWERTCANVNSKLGFGRAKEAWSVLKALRQDTKGKSNLQLVTQKEWEEYFKKLLNEDRDEYLEEGTVEENEHHDDEIXISESEVLQVLRTGKNGKSPGPGNINMEFLKYGGDKIVKLILQLFNKMXHGDSVPKEMKLGYISTIFKKGDRKICSNYRGICVTNTLMRIFGKIIKNKLEKNFRTQQEQCGFTAGRSCVDHIFTLRQILEKHREKSKNVGLIFIDLEKAYDTVPRKLLWRALHRANINTSLIKIIEQMYKDNICQVKIGNTLSQKFRTSKGLLQGCPMSPTLFKIYIDICLRTWSQKCNSMGLEIRDGVYLHHLLFADDQVVIAQDGEDANYMCNQLAIAYKNWGLKINYQKTEYLTNDPHELRIEGKKIKKVNTFCYLGSILETEGKSDSEINKRISSGRKVIGMLNSVLWSRNVMNRTKKIIYKSIFESAVLYGAETWTINQKHTKKLQALEMDFWRRSARISRKEKRRNTEVIKRMEIIERIDEVMDRKKLRWYGHVRRMEDTRIPKLVLEWQPEGRRRRGRPVTTWIKNVQLTMNRLGAEEEDTQDRHTWRNIVNN

SEQ ID NO: 2973 - protein, 558 aa, synthetic construct
  source 1..558: note = Description of Artificial Sequence: Synthetic polypeptide
  VARIANT 165: note = Any amino acid
RRHLVLINKQDYIQKVFEFFDKNGIIKIPCDPTNKYIAQTRKIIKSCSSILSDKDKRKYIPMNPKTPQLRGHPKTHKELSPIRPVVDSINCPTYLISKKLNTLLQKYYTYKKKYTIKNSRTLAANINKIDIPINGKFVSFDIINLFTNIPVKETINIIELNLLSXNKLPINSTYEIINLLHLVLEQNYFKFEDNFYTQPDGVAMGCNLASTIADIFLNTLEERFFLHQETNKIIYYYRYVDDIIVLIDGNETDINNIHGLINKLHPKIKFTMELETNKTINHLDLTIQNVQNKHRFEIYRKPTTTTNIIHAHSCHPSSHKLAFFHSMINRLINVPLDDAAKQKEMTILQYIAQQNEYDPNIILKLYNNKTSPRPPTTRTEITLQRETSKLNKPIYISTPYLGKISNKVQQIFRKTNTTFAFQNRHTLKHKFVTHTTKPSKFLNSGIYKISCNSCNKYYIGQTGRNFTIRYKEHTRESEKNPSTFYQHLQSENHTVDTIDNALEILHTVQKGYEMNILEEMEVCLHAIKNTNNLLNDQTDFKHKNYFDNFIHILVHDNG

SEQ ID NO: 2974 - protein, 990 aa, synthetic construct
  source 1..990: note = Description of Artificial Sequence: Synthetic polypeptide
MNRSRMDKKDLTFSMKSDTRIGMWNVQTMWQAGRLAEISREMKRYNIQGDEKILGLSETRWTGFGEIKTQEGDTLLYSGREEEHRGGVGLLITQKTKKSLIEWYPVSERIVVARFASRVRPITVVQCYAPTEAGSEEEKEQFYGQLHRTLLKAKKKDIMVVMGDLNAKVGNDNQGVESIMGKHGIGNRNDNGERLIEFCSNHRLVIGGTIFPHKNCHKVTWVSPDHRTENQIDHFTISKTWRTSLLDVRNRRGADVGSDHHLVIATLRLKIASTRNTQQKRRIKYNWDKLKNKEVQQCFSLELSNRFQQLREDEEQDIERNWKSIESTYIDTCEKVLGKRERGREEWITSETWEAVNQRKECKKRLNTARTQEEKVQARTEFNELNKMAKRRFRRDKRAFINNLAAQAEMAAQKNDSKTLYDITKRLTGKCFRSEKPVKAKDGKLLTSQKEQLERWREHFLEILNRQTVEEEVTEAATEEEQEDVDISIEPPSRIEIQRAIQQLKNGKAAGMDNITPEALKVDVSTSVEILFPLFKKIWEEEKIPTDWKKGLLIKLPKKGDLSECDNWRGITLLSVPSKVLSRVILERIKKRVNSRLRKVQAGFREGYSCTDQINTLRIILEQSTELQSSLYLLFVDFEKAFDSVMRKKMWKAMQEFGIPKKIIKITQEMYENYTCQVLHQGMLSEPIPVDTGVKQGCLLSPILFLMVLDLVMQKAMNRRRGIQWGLTGRLEDLDFADDLCLLASSYKDMEAMLNDLKTEASEVGLKINGKKTKEMRCNNRNEALFFFKPRDRASQAVLLPGKFSHPGGRTIEDIGNRINKAKGAFAMLRPIWKSRELNSYTKLRIFNTNVKSVLLYGCESWKTNKQLISRLQIFVNRSLRNILRIWWPQVISNEELWRRTHQTPIDIEIRRRKWKWIGHILRRGKDNVARQALEWNPQGSRRRGRPRNTWRRSVVAEGTEKGGKAWTEIKTLAQNRVRWRKFVDALCST

SEQ ID NO: 2975 - protein, 938 aa, synthetic construct
  source 1..938: note = Description of Artificial Sequence: Synthetic polypeptide
  VARIANT 115: note = Any amino acid
  VARIANT 503: note = Any amino acid
  VARIANT 508: note = Any amino acid
MRLSIQIIEKPAVDVIALQETHTADDQQIKSRGKIPGYKLIASNNHSKCGLAIYVKHTINSLKQPFKMWSSNLRQAYIKNYQVVSVSSENNIFTISAKIDSATIVNVYKPPRVNXPTPPLPSQQHPTLFLGDFNSHHNLWGYCENDSNGEALCEWMETENLKVIFDAKDPPTFHSGCWNRGYTPDLCFTTQLHSSHTQIRRSALRISLTVSTDLSFSRDWNMCTPCAVTPETKVEFQESRKSNVDKATDLLQSLDENRKKIWHETVESFDHTHSSRKAWSIIRKLDATNQTPVRPKTAIKLNDFAKHLISNSKSPKDKQTRREIKTQLNTKKRAAPNSSKFSNPFTEEEVRDAIRNMKVGKALDSMGSILNFSHTVDQQLSNGFLTSSQTFSPLEIFHHYSRKPSRGSKRCHQKHESWKGAGFDGIYPEFLTHCGPATIKWLSNFFSDILSTGNLPPLFKKTKLIAILKPNKDPTKVESYRPIALLSVTYKLLERLIYNRIHXTINKXIPIEQAGFRPGRSCNDQVFALTTHIESGYEKKFVSIAAFLDLSAAYDTVWREGLLLKFVSIIQCRKLTNLLSNMLSNRLFQIYSDNDRSKVFKLNDGLPQGSVLAPLLFNLYIYDLPATSSRKFIYADDICLVTQSPSFTTAESTLTADMEILDTYFRKWCLRLNLQKTVTSAFHLRNRHSNYKPEVKLRGQTLQYCSTPKYLGVTLDRSLTFRQHLSNVAAKVKTRNNIIQKLAGTSWGCSAQTLRSTALALSYSVAEYCCPTWMNSVHSRKIDVQLNQTMRLITGCIHSTQTAGYQFHPTSSSTRSDALLKIWRNIQKNPQLPIHSDTSTAEHQRLKSRKPSWKTAHHLDVTNFDINEAWKSHWEESSVSTVIWLKTLQCEFQVSHSPDASGESSTASEQDKGTADIYSTNGAGQHLPSVTVELPYKQ

SEQ ID NO: 2976 - protein, 1570 aa, synthetic construct
  source 1..1570: note = Description of Artificial Sequence: Synthetic polypeptide
  VARIANT 1230: note = Any amino acid
GQVWRSGIFFENASGAVLIQTASPAQSRALLACDKLGDVPVSITPHKSLNMVQGLIYHRDLLSQTDEELRANLERRGVHFVRRVYRGPKDQRVATGAFILAFEGDTLPEKVKVMIYRCDVKPYVPPPMRCFRCWKFGHMSSRCTSSPNCRECGRPSHPDAPCTPPPVCVNCGQHHPPCSPNCGVLHRERKIMEIKTLDRLTIQRHVKSMSGSIRAAPSGKDDNIFCRSHSGTSFTAINGQCSLLCGPYGPTTSTAPSMGGGTSSSVAPTTPPVGAITPSPSGTSVPAPSRRRNSLLRLLSLGRGPWDTPFRGFSQCTGDPSQRLKGPRPAGRRASRSSSNPDATTEKPSQASKPKGQREGRQKKSKKKETLVATKPQAPSSSASEDEVEILASPEDLAIPGSPESRIADTGDSEQLAADVMDEPVLLYGFSARRPVLLQWNCGGFFNRLAELQQLLCRFPVLCLALQETWFPAQRTPALRGYRGYYKNRAAYDRASGGVCIYVLATVPSAAVPLHTTLEAVAVRIRAMQEFTICSIYLPPDEAVSIADIAALIAQLPPPFLLLGDFNAHHPLWGGTQTTGRGRDVEALLSQRDVCLLNTGAPTHFCVARGTYSAIDLSVCSPSLLPHFRWKVHDDLCGSDHFPILVSLLHFQPAGHQPRWSLRRADWQRYASAAVVPVPLPADVDMAVHQVTSSIVSAAEATVPTTSGSPRRKSVPWWTPEIAEAIRDRRRALQRHRRHPTMENLIAFKRLRARARQLIRQSKRDCWEQYVANIGSRASSSQVWSQVRRLFGHRPPAAIPSINIQGTVCTDPTAIAEHMADHYACNSATAAYSAAFRALKVRVERRHLSFHTRRDETYNAPFSQWEFQTALAACPDTSPGPDRIHSQFLRHLSAESQHQLLALFNHLWAEGAFPSQWRESIVIPRNVQCAIQSVGIPNCPCCMPRYLPGTRPDPQPVPSPPFSRVPTPASRPVQPSMGRGGFPITMAGKHRYPVMKPGADPQVADSYRPISLTNVLCKLLERMVSRRLMWILEHRGLLSPRQGAFRQGRSTVDNLVALESAIRTAFSRREHLVAVFFDLRKAYDTTWRHHILATLHGWGLRGPLPLFIQNFLSLRSFRVRVGTSLSSPRIQENGVPQGSVLSVPLFLIAIDGLAAAVGSSVSSSLYADDFCLYFSSTGMGVAERRLQGAITKAQSWAMTHGFQFSASKTRVMHFCRRRAVHPDPELYLGXDLLRVEQTHRFLGMQFDARLTWVPHLQQLRKKCWRHLNVLRCLSHTAWGAARTSLLQLYKALIQSRLDYGSLVYDSAAPSALRVLDPITIVASVSWGSPPSESAGSSYWLLVARIHASPDHPNHRLLFPAAVLPSPRRRPRSGLPIAVRVRSLLSSLASLPIPPTFHYLSRTPPWFVPRLQLRLDLSSDSKASVSPMVLCRQFQALIDSFHGAEVVYTDGSLVDGRAGYAYVHGDHVEQHSLPCGTSVFTAELVAISRALTHFRDCPGESIVICSDSLSGLLALDQFMPKHHLVRSIQDAVFTLGESGRSVVFVWTPGHMAFRETNESITWPSRPPHHGP

SEQ ID NO: 2977 - protein, 1134 aa, synthetic construct
  source 1..1134: note = Description of Artificial Sequence: Synthetic polypeptide
MLIKLLQKDDHTTRQPIAIQSVSTKDTQKCQNNPKRRKLCQLSLKIRLHHGWKKNLHQYQPQQIPLKKTRPNRRNERRQGPTEETSSEVSDKIMTPFLKILKKKKRFKAVLFSVPSKHPVHKNKVQQLEVELQTLNSSLVCITEHWCKGHELTHVALKSYVLASHYSRTTLQCGGSCIYVKEGIVFKVRDDIIALSEDKHIEISAIEISKLNVLKRLTVLCIYHAPSGDMDTFIAKLNTSIGHGLMYSKDSLYYVFTMLPVVTWILLLQSLTQALDMVSKPKGRILICGDLNINTLNADGTCITFLNTLHSYNISPLINTATRITKNSASCIDHMLTDIEKDMCNVVVDHLGISDHSSQFLKVNINVETNTKLLKYIRVFSESKRSVFASQLASESWAEVYRESTVNGKFSKFLSIFKFKSEEVFPKVLRVIKAQNKNNWVTNGIRQSSKTLRHLSTIKNYNNTIQNFYNTYKKVYRKVLLAAKRYQNDKLIEKANNKIKAAWDVTNRVTNRKKAGQINIQFQLNGTSVNDPKKLANFANKYFSNVATKLQQKFVNNTQHPHTLNNVPHTMFLQPSTAEEVSKVVQNLKSKSSAGIDEIPVCLLKDCTQSISHPLAHIINESFTKGCFPETLKHAKVLPIHKKGDPESIESIENYRPISLLSSFSKVMETIMKNRLMAYLTKYNLLCKEQSGFRSGKSTSSAIAQFTNAVLEALDKGDHVTGIFLDLTKAFDTVDHTILLNKLEALGVRGVANMWFHSYLQNRVQQVEITKTNSNHTIKHLSEPEYINIGVPQGSVLGPILFLIYINDFPQSVKHGKSVLFADDSNILITDNSQIKLNQKAEDTLVHVSRWVENNKLTLNVKKTTASTSTQINPQCKKNNSINFHIKRKPVTNFLKIKDENIECVSTTKFLGMHIDSQLKWTEHITVLGKKIASACYALRIINSVCSSSCTRTAYFANIHSLISYGIIFWGTNEQNRQAIFKLQKRAVRIMTNSSSRAHCTELFKYMGILTVPCEYILQQSSTLEGPLYRIIQIYGNTNCSMRIHFTAVIYIKENINQYPPNSSIHEHETRSSRHLHLNRKNTTKTQNSILYNGIKLYNRLPQDIKNKDKIQDFRNSLKKFLEKCYYTVQDYLN

SEQ ID NO: 2978 - protein, 1834 aa, synthetic construct
  source 1..1834: note = Description of Artificial Sequence: Synthetic polypeptide
  VARIANT 328: note = Any amino acid
  VARIANT 342: note = Any amino acid
  VARIANT 382: note = Any amino acid
  VARIANT 771: note = Any amino acid
  VARIANT 848: note = Any amino acid
MGVPLGGTNTHSKKRARLGSPPDTGLCNMSMLKSNRAHSAVQNVFLVIKRKEGSFEKISPFYIQKGLEGIAGDLKSVKRLRNGTLLVETSSSQQAVNLRNAKCLGEYEIETEMHSTLNYSKGVVSCRDLVDIPNEELKEEWASEGIVDVQNITKRVDGGLVKSESFILTFNSPKLPEYVKAGFLRLKVRPYVPNPMRCFKCQRFGHTTLACKGEATCGKCGKAAHEGAECTPPAKCVNCSGEHPVWSRDCTVYLEEKKVQEIKTTKRISYGEAKKIFKAMQPPSFVTSFAAVVQKPVPKVDVSTQTDVASVGTNTCTCECTCKAAVVXEPELPHAHQKKLLXSTLQSFCHPPRQRPLARPWHLQSQRLFRRSSLTFPLLLSXTTATRTSEKATGVNITELLSPSPAEAIGQALAPSKPEAIPKVITDLSTPAVTNIKVAKPKKAPGKSQEQAKAGNKPSDYIEVIIPDLPSDSAPELMELDVPQGQTSRPKTEPPARSVSPTKRKERVKIQPPRWLPYCSGTAGFRTHVEELRLLTRDRPMCVCLQETCFKETDSPELRGYFLYRKDDLTGVRAKGGVAIFVNATYHSSPVSLTTGLQAVAVSVYLRHRLTICSLYLPPHDALDEDALRDLLTQLPQPFILCGDFNAHNVLWGSANTCPRGRAIERILLSSSAHLLNTGQSTHFCAATGSFSAIDLSLSSPALAHSAQWEVAMTYMAVTTSPSGFICQTQWYPPEPHHDGCFVRQTGPCSANWLNLNNVIASRNGWTILHXSLALFSSPCPLCSMGSGDDLHGSDHFPLWIHLPDTVVPARTPPRWVLRQADWTLFSQLAEFEQRDSVQEWVDHITQXIHRAAEASIPQSTGQLQRHPVPWWTEECRSAIRARRAALRKFKCRPTAENLAAFRLARAKCRKVIRESKKRSWQHFLNSVNRSTPSTKVWETIRRISGRGGRCPVAAVMANGTLHTDPRDIAQTMAEYFATVTSTAQQDPAFQRHRMGAEKGSLDFRSTTAEEYNCPFSMWELDSACLQLVIRALDMTGYITVCYSTLQNGTEKSSSHFLMSFGRQVIFPTHGVKQFEGQFGLQVHYCRRIQLPFLHVGARFCLSAARDTCPGHDRIHYSMLQHLTERNREILLSLFNVVWASGHFPDSWREAVLVPILKPGKDRTSPSSYRSIALTSCVGKTLERMVNRRLVWMLESRQLLSRFQCGFRKYRSTFDNLAFLEAAIQQAFLRRQHLLGIFFDIERAYDTTWRHLILRQLHEWGFRGAFPFLLCPFFLHAILGIESVTCSRIVLSKRTVFLRVAFMGFSWSLPLFIVSFLSPRYFRYRVGDVLSDRFEQENGVPQGSVLSVTLFAIAINSLTSVVKSPVQCSLFVDDFSIFCSSSSLATTTRQLQLTLRRLDDWAKKSGFKFSTEKSVCVLFNRSRSILNLPELRMRDTVLHFKETVRFLGLIFDSKLTWLPHLKDLKKRCLKALSILKCLSHNSWGADRTCLLRFYRAFVRSRLDYGCTVYGSARPSYLKMLDVVHHEGIRLATGAFRTSPIPSLCAEAAEPPLSIRQLLLGRQGYKMLSTPHAPAYHSVARPPMAGCFILGRGQHDPLGFARIVSHRWVYLILMFTSGLEQISSLAPSEAQHYFRLGSFKKGCTPDFTYRLNFSKFIGITILRWSTPMVQAGDSLGCSIVFPTMLPGFASHSLFCLHSRASRDLSIRNAACSEHTVSYLLRFTRTAITDSLYPDEKIHSSYRTNCTPSSGGVSRCHSAGSWHVGIRGNEVADGLQRRPAATTTYTICHSPAGCPLCGSAEVLSAVGRHVAAVTGNKLRSVKPTVRRGNLLPVTDA

SEQ ID NO: 2979 - protein, 975 aa, synthetic construct
  source 1..975: note = Description of Artificial Sequence: Synthetic polypeptide
  VARIANT 445: note = Any amino acid
  VARIANT 478: note = Any amino acid
  VARIANT 479: note = Any amino acid
MLTIISVNIEGLSSSKENLLHEMCQSNKCDVLCLQETHRDNNHRRPNIPGMKLVAERPHAQYGSAVFTKPDLQVKSTCHTEENNIETITVELKDYTVTSVYKPPSEIFAFTPPANFVKEKISFVIGDFNSHSHVWGYASEDKSGEAVLAWAESSQLSLIHDNKLPPSFYSRRWHRGYNPDLLFVSENIAIQSCKSVCPPIPNTQHRPIMCQLFPAIRPQNVPFRRRYNFKKANWDRFSGLLDEKIQTINPAPEEYDLFVDTIRTCSKASIPRGYRSNYVKGLDSEAATNLDRYYTLFERDPFGEETLAQANLVTSSISEAKKKEWVKQMEELDMGRSSNKAWRLLKRLATDQLNLKHANVKSNQIAHQLLKNGKPVRRNRNVQNSRQIERDISQETSEISKPFSMTELDKAISKSRNGKAAGLDDICVEQIKNFGPAAKKWLLAXMNNCMSACKIPKIWRKTRVIAIPSETWEEPDDXXSYRPISLLCHLYKTLERMILNRLTEVVEPLLIPEQAGFRTSKSCTAQILKLVQHIEDGFEERKITGAVFIDLTAAYDTVNHRLLLQKFYTSCKDYGMTQMIGNLLQNRRFFVDFQGQRSRWRTQKNGLPQGSVLAPLLFNIYTNDQPLPEGTQSFIYADDRAITAQGNTFETVESKLSEALEQLAIYYKENQLTPNPRKTQTCAFHLRNRQATKKLNVSWDGIPLVHCATPKYLGVTLDRTLTYRDHCMNTKQKVAARNNIVRKLAGTTWGAEPSTLRTTTLALCYSAAEYACPVWYNSSHAKQVDIPLNESCRIITGCLKPTPTDKLHCLAGIAPPSIRRKVAASKEKLKSVTSAAHPLFGQQPARRRLISRRSFLHTTECLTDTPQNTRTEMWRNKNVHLHDWLVPTEELPPGHGEKRNVWRSLNRLRSGVARTKSNMHRWGLSDESVLCDCGQEQTTSHLMQCELCPSTCTVEELMKATPNALDVASFWSKIS

SEQ ID NO: 2980 - protein, 919 aa, synthetic construct
  source 1..919: note = Description of Artificial Sequence: Synthetic polypeptide
  VARIANT 389: note = Any amino acid
MRLVNEIAHEKHGSAIFVRQGLQVSGSRTIQHNNIELIGVELDNTEIISIYKPPAQTFNLNIPLLSHTRDNMHTVVLGDFNCHSTQWGYSETNEDGHLLEQWAENNQMCLIHDPKQPPSFNSGRWRKGYNPDLIFVSKDLSALSYKQVLNAIPRSQHRPIKLEIRPVVQPVEIPFRRRFNFKRAKWEDFGNKLDESLKLIEPKPEHYDKFVQAIKDASFKTIPRGCRTEYIPGFTDKNKDAYERYCDLYDKSPLAEETIECGEELLEALSDQRRQTWMKTVVGMDMTHSSRKAWRLIKKLSNDPTIRTPHVNITPNQIASQLLLNGKVNGKNNAARSSLKVKKSKESNVSDVDFSVEELEEAISSLKVGKAAGLDDIRNEIIKNLSENXKKWLLKFFNCIWRTAKIPRIWRHAKVIAVLKPGKDPNDPKSYRPISLLCSLLKLFERLIMNRIGDYIDSCLIDEQAGFRPGKSCTAQALNLTQFIEDGFERGLPTGVVFIDLTAAYDTVNLRTLISKVHRMTNSDRLAEVLRALLFNRRFFVDFQQKRSRWRNQKNGLPQGSVLSPLLFNIYTNDQPIGKKTKSFIYADDRAIACQAKTSNEIEAILTEDLTTLTEYYRRNHLKPNPSKTQVCLFHLNNREAGKVLDIIWNDVRLNNCSHPTYLGITLDRTLTYKKHIEKTKAKVQTRNGILNKLTSAKWGANAKVLRSTALATCFSVAEYGCPVWERSHHTKKLDVVLNNTCRKITGCLKPTRVDYLYSLSGIAPPNIRRSFLSSIERNKQTNDHRHLLYKNQPVPKRLQSRRSFMYSVEPTVASIKSLWQEQYPEALITEEALPQGSHLDWQHWKTLNRLRVGVGRSKQLMKRWGYTDSDECECGAIQTMEHLLKCPLVDASRECTQEDLLKYTGTAAAYTDFWTSKI

SEQ ID NO: 2981 - protein, 1191 aa, synthetic construct
  source 1..1191: note = Description of Artificial Sequence: Synthetic polypeptide
MEPLREMAAKEGKKANVHSVCIPGGVIPDVERVLPDAMKGTGCSQLQVVAHVGTNDVCRFGSEEILSGFERLSEVVKTASLACKMKAELTICSIVDRTDCGPLVQSRVEGLNQRLRRFCDRVGCRFLDLRHRVVGFQVPLNRSGVHYTQEAATRVAGAVWRGLGGFFFFRELCGVDWAVFFFFRLEGLGNTQKGFQSQRVQVKDRTNTDLKTIGLTVVNCRSCVGKVPELQALIESTESQIIIGTESWLKPEISSAEIFTKGQMVFRKDRLNKIGGGVFIAVTGGLSCSEIEVDCSCELVWVEVIPDNQNKLIIGSFYRPPDSDDSIAEMFKESLDQISKTYPKHTILIGGDFNLPSICWQKYMFKTGGKHKTSSEIVLNAFSENYLEQLVHEPTRIVNGCENILDLLATNNPELIKSIKTDTGISEHRVVVARLNIGLSKSTKIKRKYIYSKKQIKIRLTLSKKIYLFKKADKNSINAFLSENLQSFETNNVSVDQMWLTFKEIISTTIDRFIPNKLTKRGLTRRGTQNRLDHCYKSKEKSMPNLNAQKIPKTGNLLQKLEIQIHTKQINKEGADPPWYTKQVRSLLQKQRKKHAKFKRTKNPQDWQSFTETRNLARTSMREAYNSYHNETLSRNLVENPKKFWSYVKYTSGKTQSIPSLHDRNGDATDDSSAKAELLNTAFRNSFTREDEANTPEFVSRTAASMRNLEVDTPGVLKQLKSLNKSKSPSPDCIPIRFLSEYADAIAPYLTIIYNRSLSERSVPKDWKVAQVTPIFKKGNRSDPQNYRPISLTSVCSRILEHILSSNIMNYLEENDLLSHSQHGFRKYRSCETQLALYSHDVMSAIDKGCQIDSVFLDFRKAFDTVPHKRLLIKLRAYGISPQLCDWIRDFLSERTQYVVIDGKSSSRTEVISGVPQGSVIGPLLFLIFINDLGDNLSSSLRLFADDAVIYRLVKSPEDQKQLQNDLDKISAWCKNWQLTLNNDKCEVIHMTTKRNPLNFSYTINQSNLQAVNSTKYLGVTITNNLNWKEHIENIVGKANQRLRFIGRTLRRCNSSTKETAYTTLVRPILEYCCALWDPHQVGLTDDLEKIQRRAARFVLSRYRGESVTEMMHELGWKSLKERRYLLRRDLFAKFLSPTFSSECEHILLAPTYIGRHDHHNKIREIRSKTERFRCSFFPRAIREWNYREIS

SEQ ID NO: 2982 - protein, 478 aa, synthetic construct
  source 1..478: note = Description of Artificial Sequence: Synthetic polypeptide
NKCSDSTNCESDKQPSNLIEKKLNKIICENYTYSRQYTVKSSTDLIAKIQDIKIPDNSRFLSLDVTNLYTNVPIDETIAIIKENLLKYRKIPKQSLNNSTITIILSHNYFSFNGHVYTQNDGLAMGSCLSGTLANIFLDHLENKFFEEQNQWKTKVVYYFRYIDDTIILFNGCIEEIEDFHQRFNNMHKKITFTIEHEINNSINFLDLTISKTNSVHTFNIFRKPTTTDIIIHNSSCHPQSHKEAYFRSAIDRITKYPLCNKNINSELNTLKDIAISNGYNPELVNNLYKSKLNSKQKSIKDEITLTKTETRKKDKFVILPYWGQISDRIKYALKKTNLKIGFYTNNTLGTNIIHKIEKIDRYSQSGVYKIECSKCDKAYIGQTGRPFKIRFREHINTSENNVSAFGTHLRESKHSTGSIEENLKILHIVCKGQLMDVLEELQIYTHMTKYPEQMLNEQTEMRNKKFIENFHNTLASI

SEQ ID NO: 2983 - protein, 751 aa, synthetic construct
  source 1..751: note = Description of Artificial Sequence: Synthetic polypeptide
GKQNCKLLSVHITISNGVCSSDWDRIDRLLHDTINKRVLTTSSRQRKKFDSLRPQPTISQLDSSRTVINLSGHLLSDDERSVLARGGNFAVSPRVVPTEEIIANIEAGIRNLDKVTAEEIRIEAVRVLARAKPPKSNLTTGEKNAIKSLNEDDSIIILPADKGNCTVVLNVTDYHCKIKELLDPQTYRKLSKDPTDKVLRTVTQLIKKSSIEQCVQKSLFNSVALPPRLYGLPKVHKEKENVPPLRPIVSAIASPTYLIAKFLTTLLRPHVGRSDSYIKNSRHFISKLNDILVNPEDILVSFDVVSLFTMVPVNEVLQQLNLLFPPDIADLFKYCLTTTYFKWNDDFYEQTDGVAMGSPLSPVIANFYMEKFEEQALKTANKKPAIWFRYVDDTFVVWRHGREELDRFLQHLNGINSRIQFTMEKEADGKLNFLDVSVFKKGNGRLGHTVYRKPTHTDRYLHRDSNHHPQQKRGIIKTLADRARNICEPELLDAELKHLSNALLKNGYSSTEIRRALRPTRRVENDERVPVKSKVFLPFIKDVTDRIGKILTKRNVAVIYKPTRKIQDHLKSAKDARKPLEKAGIYRIPCSCGDVYVGTTKRTVKKRLDEHKGNCRRGEIDRSAVAEHVFQPGDHLIQFDKTQVLAATNGYHERLYREAIEIVKHPNNFNRMEEGVKLNEIWIPVLKKKCNSLPPWDDINGRRQSATTNCARMSKTSDVTPLRASPRKRSLASVSSEPGCASDIQKCHDPP

SEQ ID NO: 2984 - protein, 1007 aa, synthetic construct
  source 1..1007: note = Description of Artificial Sequence: Synthetic polypeptide
  VARIANT 65: note = Any amino acid
  VARIANT 911: note = Any amino acid
  VARIANT 991: note = Ile or Leu
MSATTTIPNGSCQGQQNCQQNDLNRAIGPVLNVCHLNIEGISRSKCDFLSKNLLSNNTDVLALQXTHAEDLKNCARGNIHGYRLVGEIGHRTYGVATYARQDLDDVSIIHESCDDDIFVLAVKVSGTTIVNVYKPPNIQWQDTVLPVFEHPSLYVGDFNSHSSHWGYSSDNENGIALAEWAENNNLSLVFDAKDSSTFFSARWKRGYSPDLCFCSCDQTLRSLSVTRKVLGTFPRSQHRPVLISVGIKIPLIRSFPRPRWNFNKADWEAFTSKLEDNIRFIPPTTENYDRFAGLLKATAKACIPRGYRKTYIPGWSQECEDLYNEFISTEDSNTADLLLNSLDNARREKWVKKVQSLDFTHSSRKAWSLLRKLSTSVSEKKLPPTHPDPSDIAKRIVALSKSKRQQSDRLISYKLNEVKKCQQAPLEVSKPFCLDELHVAISDVKTGKAAGIDDIFPEFIKHAGLKTRLWLLNLFNNILKDSSLPKAFKRSKVIAVLKPGKPADRADSYRPIALLSVCYKLLERLIYNRIVPILTASIPVEQAGFKQGRNCCDQVLALTSFIETGFEKKCTTSVAFLDLSAAYDTVWKKGLLVKLYNLIPCPILLRLLNSMLSGRLIKIYLGNTESGFRQLHDGLPQGSVLAPILFNVYTADIPATQSRKFIYADDIAIASQHRDIHVTETTLTSDLTLLRNYFAMWKLKPNPNKTEVACFHLNNRMADYKLNISFDGVQLEHSEHPKYLGVILDRSLTFKYHLHKTADKVKTRNNILQHLAGSSWGASAKVLRTTALSLVYSAAEYCSPVWLNSAHVRDIDVQLNRAMRLISGTLMATPLQWLPILCNIVPPDLRRKEALMREYYKILSTPELPILQDLPPQVSRLKSRKPPLKTAVQLHESGFSPKSNWARTWDSFNGXNSIWIDDPSKELQGMDLPRREWSLTNRFRTGVGRCNYWKFKWGQADDQSCDCGADIQTMTHILTNCPLRSFSGGMTELHXVSQEAVQWLKELDLAL

SEQ ID NO: 2985 - protein, 1030 aa, synthetic construct
  source 1..1030: note = Description of Artificial Sequence: Synthetic polypeptide
  VARIANT 176: note = Any amino acid
  VARIANT 857: note = Any amino acid
KEQKISKGAQWCPSAINRPIQDQDRSSGTRSKKSNATPHPARPQQKGERKTSKPQILEPSADLVVFHQNVQSLTNKIDEFQIMLENELKKVSVLCLTEHWLQDDTLNMVHFPNFILGSHFCRKKRYASPQHRKQSFVVADLHKSIHLHPSFPEAFQRKIPWKYQDLSYCMKTYLNXECVLHKLSKKNRHIIICGDFNIDFSVGLETKPKTDILNLLLTFNMTPTIQTPTCVTKTSATTIDQIFASVPMEYKARTLCTGFGDHTAQEITIKMDLPLHCKTSLLTITRSFNLQNTNTFTQYLTNESWEEVYSCRDTNEKFEKFLSIFQHYFELCFPLKKRKIKKSNIKSSWITPGILTSLREKRVLHTISKQTKTTPEFDTYFKRYKQILNKVIKKSKKLTNFSYIEKPQIKCNVDYCERNRQNTGHTHSNINLLENGEEITDPHRVADLFNVYFTEIASNLIDKQQKPASENKNQQKLFIRKNNFPIPNRRKGSTEYYKRIKTKIFIRHKCATVVTKPLTHLCNSSLSNGVFPEKLKLAKVKPLFKKGDKRNEKNYRPISLLPGFSKILEKVFYRRLISFIEENNFLSNTQHGFRKQKSTETAIFDFVNEALSTIDQKEHVSALFLDLTKAFDMIDHNLLLKKLEYVGIRGLAHKWVTSYLKNRAQIVEIAHQEGSNIYTYQSERKDIKYGVPQGSILGPVLFLIFINDLETSSSSQKYIKFADDTNILIKGKTAAELQHEIQNCTSHIEEWFTTNNLVINIEKTVTMHLHTIQNKHPLTPTIKLFNKKLETVNSTKFLGISIQDDMKWDTHIKYISKKLNTICYGVRILARCTTKETLKNVYYAQAESLLRYGLIFXGNSPESRYCFVAQKRIIRSIENATPRKSCKPLFKALQILPLPCLYILEIVTYIKKISVAQNNLVYTNKSVHTHDTRQTLDLHSEHLRTTLRQNGPLQMGEKIVQQTSSPYQNNQRTPEVQIGCKKLFTRKIIYKINVITLSVNICQLNLMSCFLTYNYCNYCHLLYDVDCIII

SEQ ID NO: 2986 - protein, 1726 aa, synthetic construct
  source 1..1726: note = Description of Artificial Sequence: Synthetic polypeptide
MGDNFAMTSSSSSSTLPFTQKRKLDESKSKKVLPNLPKFLVVSRTDGHDFSSVNPFVIQRGVDAIAGPVKTCSRQRNGTLLLETEGAFQVQKLLRTTLLHTFPVKVEPHRTLNSSRGVVFSRSLDGLSDEELQEYLSDQGVTAVHRVMKRVNNNLTPTQTNCVLDLHRPKQTVFLTFDKVDLPSKIKAGYEIISVRPYVPNPTRCYQCQRFNHTRQSCPNAAKCVTCGRDAHEGDCPPPSPRCINCMGDHAANSRECPVYKDERAIQEIRVKEKVSTSAARKLLASRKPAVLPAGTYSNVLSSPRPTKETGTQTCDFTFSDTVVRSASPKIARSTSPMPSAHSKSQSTSVSQKSRATKSEARTSKKDPVREDFLKTSSSQPSAAHSSNRTASKKAHKKRSSSPSPPRRDSSVTPSSSRRPRPSSVSPGRSTACRSAGISPAEEAAPSDQSRKEAEQMSEPMEHDCPSVDCSSSAASQPGPQRPSRSPLAFSLFFFSAFFMALLQWNIRGIRSNRDELRLLLRLHCPLIVGLQETKLRPTDHINFPQYTAVRFDLPPVEGIPAHGGAMLLIREDVYYHPIPLQTPLQAVAVRVTISTFTFSLCNIYTPSSSAVLRADLLHLVAQLPTPFLLIGDFNAHHPLWGSPASCQRGSLLADLFNHLNLVCLNTGEPTFLSDTTHTYSHLDLAICTTPLAHRFEWYVLSDRYSSDHFPCIISLLHHTTSPCSTSWNISKADWGLYSSMAVFHDQNFPSCDSQVNYLTDVILTAAEHSIPRTSTSPHRVPVPWWNAACSDAIRARRRALRLFQRRPTLENCINYKRLRAKCRRVIKESKKACWTAFTSSFNRSTPSSVVWGNLRRLSGTKVHSPIPGLNIANQVLVEPVDICNALGRSFAEVSSSANYDPAFLPRKQAEEARTPSFTSPNRESYNATFTMQELERALALSRSSAPGPDAIHIQMLKNLSPAGKCFLLRTYNRVWTEGEVPTRWREAIVVPIPKPGKDKHLPSSYRPISLTSCVCKVMERMVNARLVWILESRHLLTNVQCGFRRHRSSIDHLVTLSTFVMNNFLRKRQTVAVFFDLEKAYDTCWRAGILRTMHTWGLRGRLPLFICAFLKDRMFRVRVGSVLSDTFRQENGVPQGSVLSVALFAIAINPIMDCLPADVSGSLFVDDFTIYCSAQRTCLLERRLQHCLDSLYSWSVANGFRFSHEKTVCINFWRYREFLPPSLHLGPVALPFVETTTFLGLTLDRKLSWSPHVSSLAARCTRSLNVLRVLSGTSWGADRTVLLHLYWSTVRSKLDYGSFVYSSARPSILRRLNSIHHRGLRLAIGAFYTSPVDSLYAEAAELPLTYRRDILLCRYACRLLSMPHHPSYPSFFNDSLDSHYGLSAIALLPPGVRFRRLLRQLDFTLPSTFQIGESPVPPWLQAQVRVHLELTSLPKESTSDAVYRSRFLELRAWLENSVFIYTDGSKTNEGVGCAFVIGDDGFQYRLNDHCSNFTAELFALYQAVLYIRRHRSPSYVICSDSLSAIQSLRDPFSAHPVVHRINRSLQLLAADGPRVHLLWVPGHAGVPGNEAADAAAKAATLLPRTATYCVPSNDIRGALSRRLISSWHNVWSSLTNNKLRTIKPLPVAWRTTSRRSRREEVILARLRIGHCRFSHRHLLTGDPAPLCSCGHPLTVRHVLLSCPNFTPVRIALNLPDTLEEILADDARAAARVLNFINLTNLSKDI

SEQ ID NO: 2987 - protein, 1052 aa, synthetic construct
  source 1..1052: note = Description of Artificial Sequence: Synthetic polypeptide
KTTYIVTTAEHRRAKDQEDLLCVRIFYGFSTRRKAVTNQPGDSSNTQVGAKSSVTVQESQCSFRIIHQNFGSLGNKHNDLDVLAFVNKPDVLVITEHWYPKDKISVMHPLMMNLCSSYSRMNKSGGGVAIFAKSGSNFIVSFYCVIDVSSLSVEGVIELSAINYRWERQHIIIVGVYRPPSANIDIFLTNLNQLLVEIDNKYSGKNGCINIIITGDINIDTLSNNSTTKRLQLLLQEFNLNLLIKEPTREVGGTRTCLDNIITNMDKFTYKTAVLKLAISDHHAVEFQCVPNINLHLVKHKPPPGKMKRYETKRTINDKNIRNLTHVLQSATWAETNCYSYENFASDFFYYFDMTCPTKSVIVNNNEKCRKVPGRKMQKSTWIDAEVTQARNMLTLFQCKMLENRENTKLKEAFNKYHEYYKNLIGDKRSKHVAHILNNGNNTAACIWNVINSFRAGKDNVINDLVISYNGSVIECQQDIANIFNEYFSSVGKSINDRLHNNKYAFKGKASSYSIYFTPTNSNEIRNIVKTLRNSKSAGYDGLNINIVKSCIDSISGPLSTAINNILTSGSFPDSLKIAQVTPIFKKGDRLKIENYRPISILPVLSKIIEKVIYNRIVTFLNKHNIIFENQNGFIKNKSTVTAAAQYIQLLHSIFDEVITAIENKEYVTGIFLDLEKAFDCVNIPILLDKLWNIGVRGIAHDLIKSYLTNRKQFVVIRTSSGTYRSTVTDMKYGVPQGSVMGPLLFLIYVNDIKYCTQNSKVILYADDTSIVCKHKELDQLEILSNCLTNEIVQYFNESHLSVSTAKTAVMDFNPSRQTDFEIQLCIGKDIASKENCVKFLGITIQDTLKWDVHVDTLASKLAKNIFAINMLSKHCNDTQVLRTAYHALMSSNISYGIEVWGATTQANLNKILKLQKKAVRIICGAKPKDSCRSLFPKAGILTVVNMYIYKSIMLIRKLNLNLNSDTHNYNTRNKDKFHLLSHRTALYERNPLYAGQRLANTIPSCITSLPTEKFKVTLKRILITNPHYSLDEYFCFAQNKENFIPDSLTSV

SEQ ID NO: 2988 - protein, 1085 aa, synthetic construct
  source 1..1085: note = Description of Artificial Sequence: Synthetic polypeptide
  VARIANT 615: note = Any amino acid
  VARIANT 649: note = Ile or Leu
  VARIANT 698: note = Any amino acid
  VARIANT 717: note = Any amino acid
  VARIANT 731: note = Any amino acid
  VARIANT 760: note = Any amino acid
  VARIANT 780: note = Any amino acid
MPPLRQMQRLTRDQNQQMRNPRNHTARRQRNGGENSTTQPLTRSERTQEQRDRTHQAREEDVATAALSSSSTVPATPRENAPRFEDMVTLLQKLRDLIKEIPRQITAAVTAAIQAISTGPVMARSQQGLTIAAWNANGIRTQEGEFRQFLREEAVDVCLVNETFLKPGVHVRAANYVCYRTDRTTHGGGTAVYVRASLAHHRVQLPPLQAIQESHSGSGRHIHRQDHIRRSLQTTKDCGTTCRRRNFTVTPGKVFAAGDFNAKHHIWNSRVINNHGWHILREAQHNDAMAIGPNDPTHFPENGGQPDVIMLRSDPFPREWGTAGCYYVALIKGVPYVISASTRNVLSSDHVPVVLDVDVDAGPAKRRGLPTNSTNWDRYREHLGNSLQDAPMVEDAGVEDNVRTFTKNAIQAVKRATPRLQRDPPDRSRQLPPDILAMITAKNRMFREWQLTRNPATKRAVNRMQREIKAAVKAHRHQEWSNKLATLRVDDGTGWKATQMFLRRRLKIPPLQVGPTIVSAPEDKANAIADVFEANFTPVQDPIDPEHVRLVQERLPTFLNAQKSVQKRCPGFYAASINEKLEAPTSSLTKCFDRCRQKPQRTLQQRHCIMRTGHXPQAWKHAEVVPVPKPGKDHRLPSNYRPISLLPAXSKVFERVYLKRLMDHIRRENILPDEQCGFRPGHATTHQLLRLVEEALDXTERREYFGAVFLDVSRAFXSVWHDGLLFKLLDXRPAPAARPINSVVSPRQDVPGAHWKRPSXRPNVGNTSGQYSLTFRERSXPSGMTVYSSSCWTSGLPLPHVRLIRSYLQDRTFQVRTEELSTRRPIRAGVPQGSVLGPILYILYTADMPRIDRVHLALYADDTALFSRSMNARTLGTRLQRASDELSRWATKWRLSFNGAKTQALIIARKRVPVDLPRLSVRGTAVPWGRTAKYLGVTLDRRLTWQQHVDDVIGRARGRLRDLYPFLNPTSTLPPQLGVAIYTTLIRPIFEYAAVVWGNAAQTHIKRLQGLQNRILRLALHLPRDFPTEDLLRVTEIPPIQARFRQAAKLFYQKAARSPNALIRALGHRVQRLNATRWPHLLRSD

SEQ ID NO: 2989 - protein, 1025 aa, synthetic construct
  source 1..1025: note = Description of Artificial Sequence: Synthetic polypeptide
  VARIANT 5: note = Any amino acid
  VARIANT 941: note = Any amino acid
GLHQXNVDILALQETHIEEPLNNARGNIPGYRLVAAIGHRAYGVSTYVRQGLDDVTVKHNSSNDDTFILAVKVSEITIVNVYKPPNTQWTDTVLPVFEHPALYVGDFNSHHSQWGYPADDENGRRLTSWAENNNFSLIFDAKDNSTFYSARWRRGYSPDLCFCSCERSSKPMTARRRVLGAFPHSQHRPVIISVGTQIPIIRSFPRPRWNFSKADWETFTSKVEQSIRFIPPIITTTVSRIFSWLLLNSVSPGASGKNTCQDGVENATIFTRSFKTPKALTQPTICCSLLTLPGKRSGQSRLGDLYFKGRAEHQVYPSHNNYDRFANLLLAIAKQCIPRGFRKEYVPGWSRECDDLYKEFQDTESPDTADHLLQSLDTARKEKWIKTVENLNFTHSSQRAWSLLKKLSSGKPADNCTVTHPNPCDIAKRIVSSSKSARLPSDKRVAYKLNKILRSQFTPLEVSRPFTEEELEAAITTLQTGKAAGLDKIFPEFLKHIGPKTKFWLLTVYNAILATGNLPKAFKRSKIVAILKPGKSPEQAESYRPIALLSVCYKLLERLIYNRISQILDASIPVEQAGFRPGRNCCDQVLSLTSFIEKGYEMKKKTSAAFIDLSGAYDTVWRKGLLLKFYNIIPCPLLLRFLNSTLSNRLIKVYLGHKESAFRQLNDGLPQGSVLAPLLFNVYIADIPATQSKKFIYADDIALATQHTDLPTTEATLTNDLATLQEYFRTWKLKPNPNKTEVSCFHLNNKLANQKLNIYLDGVKLTHNNHPKYLGVILDRSLTFKSHLQKTAAKVKTRTNILQQIAGSSWGANAQVLRTTALSLVYSSAEYCAPVWLNSAHVREVDVQLNRAMRIISGTLLATPLPWLPVLCHIPPPEIRRQEALIREYKKILSTPQLPITQYLPQNLSRLKSRKPPLRLASQLIAEDFSPNTTWAASWDXFEGRNKHLIPSPSTKVGGMNLPRREWTLLNRFRTGVGRCNYWKCKWGMTLDQSCDCGADTQTMDHIAIDCPCVLSLRGWLVFTI

SEQ ID NO: 2990 - protein, 841 aa, synthetic construct
  source 1..841: note = Description of Artificial Sequence: Synthetic polypeptide
MTTPAVKAFIYDQTPLRRGYVNIGSAVREHAKKSQQLCSLTFLLRCRDTSTVPKFLKVKRTFRSAQAHRIYSRMESAMLRERIHQTRRALAETNSKLFQLHLLISNTMQCDDWNKIDNLTFRTMEASAEIAGNRQKRKFDSLQKNVLVGTMEDNSRTVINLSDKVLTADEVLVLAKGGNFAVTPRKVPTEDIVANIEAGIRQLSQQSADVIRMETARILRTCKPPTSNLSQAQRKALRDINADENIIVLSADKGNATVVMKSEDYHEKIMDILDPSNYKQLRKDPTSKILKMTNQLVKASSFSSDDKKHLCKTEAYSPRLYGLPKVHKQLVPLRPIVSAIGSPTHEVAGHLASLLQPYVGGTDSHIKNSCHFIDIIKELSVDPDDILVSFDVVSLFTMIPVNEAITCIADIFPSDIVALFKHCLTTTYFQYKNVFYEQIDGVAMGSPLSPAVANLFMENFEQRALQTARKRPAKWYRYVDDTFVIWTHGEEELDAFLLHLNSINPRIQFTMEKETNGQLNFLDVTVIKREDGSLGHKVYRKDTHTDRYLQKDSNHHPRQKKRRDRLSNERTDHWVIRSIGKTHTLIVIFKKILTTTHDKKRGVIKTLVDRAHKICEPAHLDDEIEHLRVTFKKNGYSDREIDRALRPRRTTRTDEERQQPKGKVFLPFINKVTDRIGKILSKYDVETVFRPTTKIKEFLRSAKDKRHPLATPGVYKIPCSCGKVYIGTTKRSVNTRLGEHKRNCRLGHTDKSAVAEHVYQEGDHEIKFNETSVIAKTSHYYARLYREAIEIFKHRNNFNKKEEGLKLDKIWMSTLQQQHDNRLISIEEVGNSRDHSTADTT

SEQ ID NO: 2991 - protein, 850 aa, synthetic construct
  source 1..850: note = Description of Artificial Sequence: Synthetic polypeptide
MLVILSHSHVWGYQEEDRNGAILNEWMDMYNLQLVHNAKDPGTFRSGRWQKDYSPDLCIISKSGNNNTTQRKVIKSFPHSQHRPVIIQFGTEIPLVKSVPLPRWNFQLANWEQFRKSLDNSIQWIPPLPSNYERFLGAIKVNAKRYIPRGFRKEYIPGWSEECDELYAEYQDSHSDSTADDLLRALNKNRREKWHKTTAGLNFTHSSRKAWSLMRKLGTDPRLSNRVAHVNANSVAARLMNISKSKVEKAYTRTVKKELHIKRSQLEPHSDYSREFSIEEVETALKMVKVNKAPGFDGVYPEFLKAAGPKTKLWLTDFFNAILRTGKLPKLFKQAKIIAILKPGKDGTDASHYRPVSLLSMTYKLLERLILNRIQETIDQIIPAEQGGFRKHRSCCDQVLTLTTLVETGFQRGLKSAAVFVDLTAAYGTVWREGLMLKLIQIIPCQKLAFLVNNMLSDRRFKVFLNGQSSRWRTLNNGLPQGSVLAPILFNLYIHDMPDTNSTKIQYADDLALVFQSNDLKHCEQVLTSDLIKLSDYFHKWRLQPNPNKTEVTAFHLNNKEAQRKLHVTFDGIEVPHNYNPVYLGITLDRSLTFKEQCLKLSKKLASRVNLLRKIAGSNWGADANTLRSAALALVYSAGEYCAPVWENSAHTTKIDVQLNEAMRIITGTVRSTPIQWLPVLANIAPQDLRRKAAKVKLIKNVKAHKNSPLYDALQDPPACRLKSRKPPWCDTESTTSFDVTSKWQERWNENPPHNGHLVQDPSKKVEGFHLPRQTWSRLNRIRTGQGRCAYNMKKWGFLPSSDCDCGAEEQTVGHIVKQCPLRAFNGDLESLHQVTESALDWLSNLDISI

SEQ ID NO: 2992 - protein, 886 aa, synthetic construct
  source 1..886: note = Description of Artificial Sequence: Synthetic polypeptide
MFYSCDDNRHEFGTGFLVHKYLKHLVMNFTPINPRLSVIRIKGRFFNYSIINGHAPTEESIEDLKDDFYDALEKAYDKCPRNDIKIVLGDFNAQLGREDMFQPVIGAHSKHGSTNDNGIRLILFAASRNMIVGSTSFPHKEIHKGTWKSPDGRTINQIDHVLIDQRHKSNLLDVRTFRGPNVDSDHFLVMAKIRARISNAQKERNHRTKMAAIKRAIDISAKETLGIERESIRPTWFDEECKRVTEEKNTAYQKTLQANCTRSLLEDYREKRRIEKMTHRRKKREWTKAEIECMELSKKKMKQGILKTICSITSLIRDEEGNIISEVNRLWKDGEDTLMTCESRDEQAEDISNDCEQGLDDEQPLDGPGLEIKKAKSLRKLKNNKAPGTDSIPAELLKYGGATLEQSLFELITLIWEQERIPNEWNEGILCPIHKKGDRMECRNHRGITLLNLGYKVLSNIIFDRLLPQVDKEIGMYQSGFRRGRSTIDQIFNLRQILEKTVEYRIGTHHLFIDFKAAYDSINRNQLFHALQEMGIHGKLLRMVKMIVVQGNYSDPLEIKNGLRQGDALACLLFNVALEKVIREAGLQTRGTIFYKSVQILAYADDIDIIARTVPALKEAFTALSQASKKMGLMINEDKTKYMACGKAYQPNMPSTFSVNGYTFERVDTFKYLGSTVTCFNDTSTEIKIRLISANKAYFALSNLFQSRLLSRPTKFTIYKTLVRPVLTYASETWPLTETDARLLDGFERKVLRRIIGPVYDGEQWRKGTMQNCTLYMPMLLWRTMEERYNAELYTIYADAPVTNIIRSGRIRWAGHVARMEESEVTKKILFGNPGGQRGRGRPRARWLDGVEEDLRKLGCRNWRRVAYDRDGWRKLVGKAKVHPGL

SEQ ID NO: 2993 - protein, 986 aa, synthetic construct
  source 1..986: note = Description of Artificial Sequence: Synthetic polypeptide
MKTNKTPPKRSFPRPLVTISINIEGISRDKEVLLSDLCKEYQCDFLLIQETHRGITRPSPKIDGMKMILERPHEQYGSAIFARPGINVTSASLTDRDDVEILTVRTQQYSVTSVYKPPDSTFVFTEPANFSYQDINFILGDFNCQSTAWGYKETNSSGAELEKWAEVHDLLLIHDPKLPSSFNSGRWKKGYNPDNIFVSKKLAAQSEKLIGEPIPHTQHRPIICTVSAVVKPEQVPFKRRFNFKKANWKKFREIIDLEVTKILHNLRCMTLLSVFRMCLGRQYARMQNTVYRWTSEDAKPLLERYQSSSTGNELMSVIAENRKAKWRDLVENLDMKVNSRGLGNCRTSTVMPQSQTINLLMSLQTSRHHTLLNGKPRQKIPQPLTRVLAEKPHLKAPFTMSELTAAISSLKTNRAPGIDELRVSKLKTLAVIPYSGCTESQQIKNLGSNTLQWLLDLMNACVERLHIPKMWRKARVVALLKPGKDPNDPKNFRPVSLLCHCFKILERLTLSRIENVLEQQIIPQQAGFRQGKSCCGQVLNLTQHIEDGFERKEITGVAFIDLTAAYDTVNHRRLLRKVYDVTKDYHLTSLIATFLQNRRFFVCLQGKKSRWRNQRNGLPQGSVLAPALYNIYTNDQPVPNTTRQFMYADDTAVAAQGTNFLDVEEKLSSTLESLSQYYEANHLRPNPSKTQVCAFHLKNAEANRELNVTWRGERLAHCPTPKYLGVTLDRTLTYKHHCNATREKVSARNNIIRKLTNGSWGANPKVLRTSALALSVSAAEYAAPVWSSSTHARKVDIAVNEMARIVTGCLKPTPVHKMYLIMGIAPPNIRRDIAAEAEKTKQEKDMRHPLYGHQPADRRLRSRKSFLSRTRALEGSAAENRIARWEMDLRSPHKAAKEELAPGGDLPYTVWRTLNRMRVEVPKCKTNMQRWGFLKDNENTLCLCGAVQDPQHLLICPYLEKPCTMEDLWEANDKAISAANFWKLEV

SEQ ID NO: 2994 - protein, 1360 aa, synthetic construct
  source 1..1360: note = Description of Artificial Sequence: Synthetic polypeptide
  VARIANT 96: note = Any amino acid
  VARIANT 767: note = Any amino acid
MESKIDVFGDSHAKGISQELQVISKSSTVTGMVKPGAGFKEVTKNIVKYKYGKQDSVVICAGAKDIYENNAMKMYKQLLSLILVLSNTNIILVNFXLRHDLPEWSCVNKEIHRINEKLKSCCRLFSNVKLIDSSTLHRECFTKHGLHLNNNGKARLGNLIRDAIKCNSKWTVTELGWYKCPTAETPAQTATAPRSTIQKTVATPTEQPTTEPKLTATSEPTSEVTVKTSKFNQPESSAFTTTVAEQTSVAVAPKQITSQPESLAYTATTAVAVVVAAVVTPEEGSHLQQSSHQKKAATFEKPGFLLGPGSEQQQIIGKHLNDCNQKNLQQGQLVQEADSNQGRESGNINRTAVSKNSNLKIMHQNIQYASKKSEELEVLLAAEVPNIFIMTEHGLKDSELKVFNLEGYKNVAYYCRNEHKSGGVAIFVDSKVGTTPLDISQIAQISTLKQQQYKSSWGGKCLIIGIYRSPSSSIENFLLELEVLLQKVMKKYTFVILAGDLNIDMLRDNDCTRRFQDILGSYNLQLHVKSPTRCTETSSTLIDHILTNIPTERQKVQVINTVIADHSGQTIELKDYAKAEDKKMIKYRQTNIANLNSLEILVKAEEWDDVYNEHSVEKSWESFCDILRHHINVACPVICKTVSAKQNKKWITKEIKKAREELIKLYEDYQKDKEQASQEAYRSKKKLYTRMIREAKASQYKHEIKTSTNISKTVWNLINDNRKESQTSKDTNIILEMEGVKVTDPLQVANSLNQHYVAIVEKLLNQXTPVTKSIKSPKWVAESLYLLPTNELEVSKIIGALKNKNTEGLDGISAKIVKHCAKYLATPLTFLINLTMKEGVFPNCLKRSKVVPVFKGGDKEDPGNYRPITITTVLSKIVERVINDRIVNFIDKHNILNEAQHGFRKGRSTKTAVANFITYITEALEQRRKVSGIYLDLSKAFDCVCHKILLKKLNCYGIRGNAADIIKTFAENRQQCVELKHKCRNKEEKVYSEFQQVKYGVAQGSILGPLLFILYVNDMPTEINEKVIMYADDTTLLVCGDTVKDLEKRATENFQMAERYFTENNLLINRKKTKCTKFETKITKSSEVFTLKIGSADLAEVDCNRFLGIEVDKHLSWENHIDKVCSKISTNIFLMRKMCYTWTQKPCGLFENKHKYILNEKNVLYVDTETLLKMYYGLIFPHLSYGIPLWGGAADVHIQRLLKLQKKAIRCCTHTETFKTSKESHQMLAKLSPRESCKNKFKEFKILTVPSLYIYMRQDTNCTKSVYIYETIVFLMVNCTAPLNSDIHNHNTRTKEQYHFFSKRLNMTDRDPINAGCRFFNKLPLSIRCIKERSAFKRKLKEHLISGCWYKVKEYLTENL

SEQ ID NO: 2995 - protein, 950 aa, synthetic construct
  source 1..950: note = Description of Artificial Sequence: Synthetic polypeptide
  VARIANT 32: note = Any amino acid
  VARIANT 51: note = Any amino acid
MDRNKLDVLGMCEVRWGGCGELESGDSDCTTXVKIKMECMELEYLRLYYSXEDKNGMYGVGILIGKRLKDKVMKVEYINGRIMMIRLKGKKEDLVIIQVYMPTSNHSEEEVEECYEKIENLAEREKRNACIVVMGDWNAVVGEGSEGKALGKFGLGERNERGQRLLEFCNENLMVVGNTLFDNHKRRRYTWISRFDNKRHQIDYIMIQQRYRNCLKSAKSYPGADIYSDHILVVAEVLVKLKRTWKGQKREFINIEKLKDKGICEKLENAFSEIIMPGQEMECIERRWDHYKNGLKRQLRKRKWVKKAAKETLGVKERKRVKKEWITPEMISKMDDRRKWKTVNTEEGKRNYRRLNNELRRETRKARVKWLTEKCDKIENLZKEGKYDLMYKEAMDLVFREKNSNSGIKEIEAADGKMVNETQEVMRRWEEYIEWLYDGDTRPSEDELGLEEENTVAEDDKGNAILTSEVEASVKEMKNGKAEGIDEIPVELLKSLQREGKKELIGLYNQIYMTGNWPKDFCESILIPIEKKKNSKKCEEHRTVSLISHTAKVLLRTLNRRLYGKLNAVMGEEQFGFRRGVGTRDAIGLLRVIGERYMEKKRKVYAIFIDLEKAFDRVRWDKLMAILRKHGVDWRDRKLITNLYLNQTARVRIGGVISEEIELGRGVRQGCCLSPTLFNIYLEDIIKESFNGSRGVCIGGRRVECIRFADDMVVMAESAKEMEQMLDDLNTKLEEYGMKINKKKTKSMVIGGRNTKCRLKIGGEEIEQVHSFKYLGSMIMDDMYCTAEIKKRIAMAKEGFKRKQRLLCGPLKKDLRKRLAKCYIWSVVLYGAETWTLRKEDERRLEALEMWIWRRMEQVKWEDRIRNEEVLRRVGEERNMLEVIRKRKRNWIGHCLRRDCLLKEGIEGMVKGKRGRGKPRYQMLDNIQGNKYEEMKRLALDREKWKRINP

SEQ ID NO: 2996 - protein, 1075 aa, synthetic construct
  source 1..1075: note = Description of Artificial Sequence: Synthetic polypeptide
MRMSVNKRSFSEPALKMTSVNIEGLSANKELLLSDICSKCKCDVLILQETHRGPTSHRPNIKGMILTLERPHEQYGSAIFTKPGLMVRSAAMTHVDDIEILTVELKACTVTSLYKPPGADFTFREPSNFQTQPLKFITGDFNSHSTAWGYQETDSNGEKVERWAESSGLKLVHDPKLPASFNSGRWRRGYNPDNIFVTEQIAQQSFKSVEDALPRTQHRPISLTVKAVVCPVTVPFKRRFNFKKARWRLFTEELDSKIDEILPAACSYDKFIQLIRRVSRKYIPRGCRNEYIAGLDDNIEILLKKYEELYNTDPFSEDTLETGEDLLRALTTTRREKWCDLVTSLDFKQNSRQAWSLLRNLSNDPTSSKTLHTSVTPNQIAHQLLLNGKTTHRSPRPSIVRDMENEHHSLEAPFTLEELQAAIDKMKNNKAAGEDDLRVEQIKHFGPKTLRWLTHLMKQLRQHHADSQSVEKSKSGSPIKTRKGANRCQKLSPSILAVPSVQGPRENGANNCVNTMQIPRVWRKARVVALLKPGKEPTDVKNFRPVSLLCHLFKALERMVLNRISNHVDEVLSPEQAGFRPGRSCTGQILNLTQHIEDGYERKQVTGVAFVDLSAAYDTINHSRLVHKVYQATKDFGLSRFVQCILQNRRFYVTLQGKSSRWRIQKMVLLRAVYGLWTFKICAVHTTEQAFLCHTARKKQQMENPKNGLAQGSVLAPVLFNIYTNDQPMHPDVRQFIYADDTAVAAQGSTFEEVEEKLTRALELLGNYYHQNHLKPNPAKTQVCSFHLRNKEAKTKLHVSWKGQELEHCYAPKYLGVKLDRTLSFKQHCLDTKKKVSTRNSIIRKLTNTNWGADPQVLRTTAMALSLSAAEYAAPVWKNSAHVKHIDVAVNESARIISGCLRPTPTEKIYPLIGIAPPSIRRQVAAEVERKKQLTDNRHPLHGHQQQPRRLRSRRSFLWTSEPIDVTVEERRLQLWKEATPNPILALKEQLAAGGNKSFTTWKALNRLRTGVSNCKFNLSRWGYLDGEPLCDCGNVQTDDHLLTCPNLSTCCTPLDLQLANDKAICVADYWARNI

SEQ ID NO: 2997 - protein, 943 aa, synthetic construct
  source 1..943: note = Description of Artificial Sequence: Synthetic polypeptide
  VARIANT 252: note = Any amino acid
  VARIANT 322: note = Any amino acid
  VARIANT 464: note = Any amino acid
  VARIANT 810: note = Any amino acid
MYNFNCRMESPLKVSTTPGGNSNEESTIALCNASGPRVLGSPNICIKGESEHPWYPSKLKFNRKFFAGTLNVNSLLKIGKQKELEILLDKHEIQILAVQETRFLDENITETKNYRIFKGKPAIKIMKGMPILGTAFCVHKNLVDKITEFKSSSERLSLLTIKCKNKQYTFVNCHAPINDDNKKNLSKVEAFWELLEDEISKIPKSNVVILLGDFNAQIGREKTFRKIVGEYPAHKRTNKNGTRLIGLCKTYXLKLMSTFFKKLPRKAKTWISPNPMLGEFQLDHVAISKHNIKEIMNVKVTRNREFDSDHYLTKIKMKLLPXKIQKRQQRLIKYNTDRLTITKDAIKHFQEEIKISKSGKWEELSKEINRVAKNVFGATKIMKKAWWNETCEEAVAERTKKWKKWKCSGKTEHLDEFKIQRKETARIIKSTKNFYQMFKNHLKGYQAPSICFRDENGKVGLSNXHNCEILRKYFEQLLNCEEPNCKLEFPDLHENTETDPPPTAEEIKKAINALKNNKASGEDSITAELIKWSQPKIISNLQLMFEEIWETEKIPEDWKVALIHPLHKKGDKQDVNNYRGISLLPVGYKIFSTIILNKVEATLDSHLGEYQSGFRKGRSCSEQIFNLKSIIRHRLTNSKDIVVTFIDFKKAFDSVDRETLDKVIREFGIKSKLANLIRETLTDTKSKVKLQGEISKAFDIKTGVRQGDGLSPLLFNCVLEKIVREWKQKLKDHKLSPIRLGTKHKGIEIHCLAFADDFAILSENLTNAEIQINLLEEIANKAGLRISVEKTKFMTNIKNAPEILVTDIGXIKRVNKFKYLGEMIQENGLEKFAVEERVHKMERAYGITRNIYNKRSLSKNLKIQHYNTVVKPECLYASECLVLNYKLHKLEVLERKIIRKILGPLRNTEVWKLRSNAEVYRNIENITETLRKRRLLFFGHLYE

SEQ ID NO: 2998 - protein, 805 aa, synthetic construct
  source 1..805: note = Description of Artificial Sequence: Synthetic polypeptide
  VARIANT 44: note = Any amino acid
  VARIANT 192: note = Any amino acid
RNGQMLIILYLFMTQNCHHHFTVKYGNKALIRISASAVLIWRQXASRQFITHSQRHNIDQLATSWPECLRRHKTADDTSRRRFNFRKANWTDFTSTLDNCIDELEPIPGNYERFVEKVRYISRITIPRGCRQQYIPGLSGESKGLLDQYNEMYEKDPFSNETEEVGNLLLKELSRTRQEKWVETIERLDMTXSSKMAWNMMKKLSADPIAPKQASNTTADQIAHQLLISGKTGTKPRSRKIHRNLESEVSLIDTPFGIKDLDNSIQSLKTGKAAGVDDICTEQIKHFGKNKTVDPTTNKVLLNKQIPKSWRKSKVIALLKPSKDPNLASSYRPISLLCHHSKFMSGNSELCGRKTNSRTRRFPPRKIMYRAGIGADRTHRERLRGENITGVVFVDLSAAYDTINQRTLLAKVYNITKDYELTKVIESLLQNRRFYVTLEGKKSRWRTQKNGLPKAVFCPQCCSTFTQTTNLLLVIQSTSFMLMTWPLGHSSSGQKLPAVEERLQNALSQMSVYYKENSLKPNPAKTQACAFHLKSKEARRKLQIKWDGFSIEHTAQPKYLGVILDRSLTYKSHCQKTRQKTATRNQLLKKLIGSKWGASPHVIRTTAEAVCFSTAEYACPVWNRSAHAKEVNIALNETCRLMTGCLKATPLGQLYKAAGCEAPATRRLAVEHTERFRQAFDDRHPLFEAPEPLRRLKSRRSFLRSVPMEPPDKYPLTQKPPPGYHLDWRSWKSLNRLRTGVAPVKTNLVKWGIIDESDVRCNCGERQNMEHLLTCKNCPRTCSLDDLWNARDNALDVARYWADVL

SEQ ID NO: 2999 - protein, 686 aa, synthetic construct
  source 1..686: note = Description of Artificial Sequence: Synthetic polypeptide
  VARIANT 541: note = Any amino acid
MIWDTVKSELDEQLQVEFLNLKSRQDQKLKKLMRQIDCRVNNAQNVDNFQFYPRVVNETDISFNDEELRLLNKGLKFNVQPSLNDKTVKELIVATKMAVDVAKLNENEKGHVGYKLANAIKAETNKSCNSMHNNSDHKTVTSINDKLISNKAIVTKADKGNTTVIVSEEQYINKTLQFFSENGVTEIAKDPTKKVQAELKQLLKRTSFLLTEKEKFQCYVMNPTAPRLRSQLKVHKNGHPIRAIVNSMKGPLCKITKKLDKILKEFYVFGDNFSVSNNTTLINEIKDKPIADTSHLMSLDIKNLYANVPVDEAVELIKANLLKHKRLSQQEIVEFIDLLQFILKYNYFAFNGKFYIQKDGLAMGSSISGTIADIFINNLENRLFTNMQHPVDKILYYKRYVDDTLLLIDGGQTEITEIVNKFNSLHEKIEFTVEQEKDGTLQFLDLNITKQDGRHLFKVYRKPTTTDILIHNSSCHPNGQKLSALRCLVDRAFKVPMNEKDRTTEFNIIRQLAKVNGYQENVVNNLIRKKQRAKSNKNGTXNIKRVMVPYFGNLSQKVANILKPFKVEAAFKTNNTLHHKLRNNLNQETDKYDKAGVYKIQCSSCNANYIGQTGRSFKVRYKEHMDAFRLNNFDKSAVAMHIRETGHPLKRIEDDLKILHKQDKGRKLDLLEQLEITIHNAKATFH

SEQ ID NO: 3000 - protein, 1912 aa, synthetic construct
  source 1..1912: note = Description of Artificial Sequence: Synthetic polypeptide
  VARIANT 14: note = Any amino acid
  VARIANT 50: note = Any amino acid
  VARIANT 90: note = Any amino acid
  VARIANT 92: note = Any amino acid
  VARIANT 94: note = Any amino acid
  VARIANT 121: note = Any amino acid
  VARIANT 170: note = Any amino acid
  VARIANT 249: note = Any amino acid
  VARIANT 261: note = Any amino acid
  VARIANT 286: note = Any amino acid
  VARIANT 315: note = Any amino acid
  VARIANT 353: note = Any amino acid
  VARIANT 357: note = Ile or Leu
  VARIANT 387: note = Any amino acid
  VARIANT 412: note = Any amino acid
MALPGAKPASLSVXGPNLMLRHMTPRRSLPWPRHGRNAGREIEVRLMPPXTWYVPGLTANRLPPRSPCFLWKTLRISSGRWMACQDEIWXCXHXDVVPSPVTGTACLVRGGGWHVKMRSGXVLITTSSPAQSRALLACDKLGDVPVSITPHKSLNMVQGIIFHKDLLLQXDDELRKNLERRGVHFIRRVHRGPKDNRVATGAFILAFEGDSLPEKVKVMIYRCDVKPYVPPPMRCFKCWRFGHMSSRCXGNPTCRECGRAXHPDAPCAPPPVCVNCGQHHSPCSPXCTVLHKERKIMEYKTLDRLSYSEAKRKYXKLHPVSMKTSMPQLHHTASAISATALHCLVFHSGPPGXTAHXCPHGLWGHLNLHRPQGPYFGSSNHHSTCGXISPHPPPLHLWGHQSPPLSQRHNSXLWLLSRGRGPSDPFLLRLLLLKDTSRWLKEPPTAGRRASRAPQFLGTEPAEPSQHEKPKEQRETKEKDKKPPKRRIPWWPPCHHPPPPLLLRTRETTQEKDSLVATVPPPPSTSSSEDEIEILASPKDLAIAESSEAMDVEALPQKSATAEDTVNPTAPSKSACPSDQEALGSASKIGDSRRYCEPYCAVEISMSQRPGGSLILQWNCGGFFRHLPELQQLLCRFPAFCVALQETWFPAQRTPALRGYRGYYKNRTIYDRVSGGVCIYVLATVPSAAVPLHTTLEAVAVRIRAMQELTICSLYLPPDEMVSLTDLAALVAQLPPPFLLLGDFNAHHPLWGGAQTTGRGRDIETLLSQQDICLLNTGAPTHFCVARGTYSAIDLSVCTPSLLPHFQWRVHDDLCNSDHFPVLMSLLDFQPAGCPSRWSLRRADWQRYTSAATVPVPLPADVDMAVHQVTSTIVSAAEATIPTTSGSPRRKSVPWWTPEIAEAIRDRRRALQRHRRHPTVENLIAFKRLRARARQLIRQSKRDCWETYVASIGCRASRLGCGPRLGAFLGTVHQQRSPAYTSRVTYAPTRLPSLNTWQSIMLAPLQHQNTVQTSVHTGLLGDVCRQHRLSRLASRVWSQVRRLFGYRPPAAIPSLHIQGNLCTDPTSIAEHMAEHYARTSATSEYSADFRALKERVEQRRLSFHTRRAESYNSAFSEWEFETALAACPDTSPGPDRIHSQFIRHLSVEFQHQLLALFNRLWAEGAFPSQWRESIIIPVIKPGADPQVADSYRPISLTNVLCKLFERMVSRRLMWILEHRGLLSPHQGGFRQGRSTVDNLVALESAIRTAFSRREHLVAVFFDLRKAYDTTWRHHILATLHGWGLRGPLPLFIQNFLSFRSFRVRVGTSLSSPRVQENGVPQGSVLSVPLFLIAINGLAEAVGSSVSSSLFADDFCLYFSSASIGVAERRLQGAIRKAQSWASTHGFQFSPSKTRVMHFCRRRAVHLDPELYLYDELLRVEETHRFLGMLFDSRLTWVPHLRQLKQKCVRYLNILRCLSHTSWGAARTSLLQLYRALIQSRLDYGSFVYGSAAPSALQVLDPVLHSGVRLATGAFRTSPVASLLAEAGVLPLRFRRQQLLSSYAAHVHATPHHPNRRLLFPAAALPSPRQRPRSGLPIAVRVRSLLSSLESLPIPPTFHCPYRTAPWSLPRPQLRLDLSHASKASVAPLSLRRQFQAVLESFCGAEVVYTDGSVVDGRTGYAYVHGEHIEQHSLPCGSSVFTAELVAIYRALEHLRACPGESLVICSDSLSGLQALAKCFPKHPLVQSIQESVSRLVRSGRSVVFVWTPGHIGIPGNERVDQLAKQATTSSPLAIGLPESDLRLEFHRKILGLWNSEWANSAQPNKLRAVKLSTVAWKSSLRSSRRESVVLCRLRIGHTWLTHGHLLRREDAPQCDCGAPLTVVHILVDCPLLVALRQSFNLPDALSFMLGDDAAMVERVLDFIRAAGFYHVI

SEQ ID NO: 3001 - protein, 552 aa, synthetic construct
  source 1..552: note = Description of Artificial Sequence: Synthetic polypeptide
MDPDIVILPADKGNATVVLNKQDYLQKMQCLLSDSAYRRISADPTKSVERKTNNLLKKSSLSQETIKSLNSYCAVPPRLYGLPKVHKDGCPLRPIVSNIGAPTYRVAKHLAGLLSPLVGRCEHHIKNSVDFLRRLEGLHLADSDILVSFDVVSLFTRVPLSDSLQLIETKFGTDLTNLFRHVLTSTYFLFNDEYYEQTDGVAMGSPLSPIIANLFMEDFEDRALESAALKPACFFRYVDDTFVVWPHGSENLNYFLEHLNSIHPNIRFTMEVEKNGCLPFLDVLVRRKADGTLGHAVYRKPTHTDLYLQADSCHHPAQREGVLRTLVHRAHVISDPESLPTELSHLEVTFRQNGYGEGQIKRALRYRPHVQRASDDSTESAPTSVAFLPYVGSTSNKIGRILRKNNVKCVFRPPSKIKALLGSVKDDLGLRKAGVYRIPCSCGMSYVGQTIRTVEDRCIEHKRHTRLQQPNKSAVAEHCLDTGHPMEYNKTEILACTSNYWDCVIKEAIEIKLGDNLMNRDGGFCLNSAWDPALSLVKKQRDKTNPTSSVEN

SEQ ID NO: 3002 - protein, 1017 aa, synthetic construct
  source 1..1017: note = Description of Artificial Sequence: Synthetic polypeptide
  VARIANT 532: note = Ile or Leu
  VARIANT 611: note = Any amino acid
  VARIANT 612: note = Any amino acid
MLFHQNVQSLNNKLSEIKIMLSNELIDVSVLCMSEHWLRDDALQTVSILNYELAAYTCRQQILGGGICIFVKKGLKKSFFFFLFFFFFFFEISAIELPSLRDNFNMHLQIPNGDIKTFYQNLENTLTQTVKNKQTIIICGDFNIDFKGSAKEKTDLMNILVSHTLKITIHSPTREIVTLSLQVYNRSNNNKPTKEQYKAEAVKTGLGDHHGQTISFHIKGIEVNKLTSTYKTRTYNDQEIEIFKNLLKSESWEQIYDTSTENISEKFDIFIEKIKYYFDVVFPVKTRRLKDTLPKKIPSQNKWITTGIRISCANKRFLYRLTKTCDTTPAFDRYFKNYKTVLRKVIKSAKKLENDRYISNSSNKMKAVWNIVKKETGNNKTKNKNIQLKENQQTTSKPKEVANMFNTYFINIAEKLIEKNVIKNPSQLATKIKHIDKTIFLTPTNTKEVQQEIKLLKSKHSSGIDNIPDFIVKKCADFLSEPLTYLINLSFSTGSFPKCLKIAKVKPLHKKGSQEEVSNYRPVSQLSAFSKXLEKLFIKDCPISQNPNMVLEKNHSTETAVFSFLYETLQALDRREHTTSIFLDLSKAFDTINHNKLLSKIQNWGLGAAHXXIKSNPHDRKQFQKAVLIEITYESNGTVSTYHSDSLVVKHGVPQGSILGPILFLLYVNDLYINNTNGKLYQFADDTSILITGSTKEIFESNIAAITKNIRDYFDANGLIINVEKPLQWIYLRHRIDHQLTQILICKWPDNKCGKTVAMDIFTTQNRSPANPNIDINGKTIEKTECTKFLGIWIQQNIKWDSHVDYINRKLSKTCYIMRTLKNSISYNNLKSIYFAYAHSQMKYGIVFWGNSGASMKTFRIQKKIIRIMEGVDQRTSCKPLLKRNTPTSKHVHNGKPNYYKRKIKKEILPLPSMYIMENLIIIKEKLNSKSPCITRNETVHCHNTRQKNNVHVKQTNTALFQKGVLHPGIRLYNALPKAIKSKTDTTKFKTAVKDYLVMHCFYSVDEYLEFQNYSIS

SEQ ID NO: 3003 - protein, 760 aa, synthetic construct
  source 1..760: note = Description of Artificial Sequence: Synthetic polypeptide
MSDWAHRSAVDKQSSKFQRLSRPSISHNTNRRTVINFTDKELDDAMLSVLEKGLNFAPTPKNVPLTEFICSVEQAVSKLPGDQAEEIRQEVAHTLRRAPPPRSNISPLERAAIRSLREDQDLIILPADKGNATVLLSRDDYLRKMDCLLDDSAYRRLQKDPTERIKRMTLSLLKKSSLSDDVLKKLHPGAAVPPRLYGLPKIHKQEVPLRPIVSNLGAPTYNLAKHLASVLSPHVGKCEHHIPNSMDFIQRLKSLRLSPSDLLVSFDVVSLFTRVPLEESLQLIGEKVDKETAELCRHVLTSTYFLFNDKFYEQTDGVAMGSPLSPIVANLFMEDFEDMALKTAALKPTCFWRYVDDTFMVWPHGEEALNRLLDHFNCMHPNIRFTMEVEKEGKLPFLDVLVYRRDDGKLGHSVYRKPTHTDRYLHASSCHPPVQRTGVLRTLTRRAYAISDAESLTQELDHLKVVFKQNGYTDKQIRCAFQFGPSPEPLNETHKSVAFLPFAGSISSKIGRILKKHDIKSVFRPPVKTRALLGSVKDDLGLRKPGVYKIPCQCGKTYIGQTSVPFRTDVLNINATHVCSSPRSRRDSLSMWENVYWSDIRTIQDRCVEHQRHTRLLQPEKSAVAEHCLDEGHRMLYNETHMVASASRYWDCVLKESIEIRLSDNLINRDKGYLLSKSGTLCYQMLKNNGWYFRNLNNNFLIIDYRFRRILPPERCMSCAPEGSYCHFLRTRYGSSAMYKGAADCTGNSVPARLCTSTLT

SEQ ID NO: 3004 - protein, 1058 aa, synthetic construct
  source 1..1058: note = Description of Artificial Sequence: Synthetic polypeptide
  VARIANT 103: note = Any amino acid
MKRPFREKFPPSNPIGKEKATSDSVGSQLEDSNESEHLKSPNYHQARNAKIKHKHINYIATHNINSLLQTGKLKNFTDELNRQNIIIAGLQEMRNTIEDPFEXQGYRIYNGKPGQRVMKQCPQFGTGFIVNLKVIDSITDFKAISPRIATLTLKATNKIYTIINAHAPTNQKNFLTRTMVEVEKFWDLLDQTINQVNKNHVKILIGDFNAQLGKERKYRDIIGKWAPHKHTNRNGQRLVEICRTYGLISKSTYFKRKPSKLMTWKHPDWTKGEWQLDHVCMDKFFHKEIQNVKVLRGMDTGSDHYMVNIKIKFTPLSKKRQRALEIKESMIHINKKTESIGDKRKYDPHKLIKNDKYQKNTQNTVITDNLQELIPILKQHAEESAPVNQTSKKHAWWTTECDEIHDERHQAWIKFQTHRTEENAYNLKNIRKKFSQIIRKTKRLYQKDVLSSIEENYHETNSRDYFKAFDKQLRKFNPPTLLLRNKDGRIAHNNKENAEIMAEAFNKLLNLTNLKSFKAFNNRHKHPCNNQTRKYSPPTVQEIETALKEMRNYKACGENQVFAEMWKYAGTTTRTSLHTILQKIWTTEKFPEEWTTAIITPLHKKGDKSDPDNYRGISLLDCTYKIFSKILHNRIREQLDKELGEYQGGFRPWRSCAEQIITLKLIMAYYRKRNKPLSITFIDFKKAYDSIHRPSLLKILRHFGLHLKLIRLTELTLTNTNSKIKFEGNFLDHSIHMREWYKANPKNIKVGTQKDNIKLNCLGFADDLALLANNIQETKQQIRSLQEIAQCIGLKISFEKTEIMVTEPPLANKIRIGVHNIKIVEKFKYLGEIITHNLNEKPSWQSRINKLIKMHHVTKNTYNKKCLSIATKLKHYKTVTQPQITYASETIFKTTNTVAIDRLLKIERRIVRTCINKKYQKDGIWRIASNETVYKEVEPVTSTMKKKRISFLGHLMRTPENRISRKIIEKLWNSKSNIRWITEIKEDMMKLQITMEDLKDKTDTLKILQDKHVTLPIKINKQRLGRVISDEERRARSERMKKYWANKKKNKNKNNRRT

SEQ ID NO: 3005 - protein, 1264 aa, synthetic construct
  source 1..1264: note = Description of Artificial Sequence: Synthetic polypeptide
MIKKNVWFQTVKSMCVQEKKRVVPDCEIDVRPGIRTNQLNNHFKNIQQAKHNSKNVTNSENYKGVFIHVGTNSLRSCSEEDLVNETRNVIRSAKNIYPYSRIIISSILRRRSVSDKYIDKINCNIRDQCNRLGAIFVDSNKFIRDDCIGQDGLHLNRLGSATFSKMFIDLCKIIRNRGNWQSVRGVNPVQNYTKQGKLAVSEGGELKHVVDKDTTKEDVLKTVNRYNSSFLMHWNIHGLRATYLQNKIAKIDELQIILSEGRNIKVVCLNEHWITEDSITVLNKLENFNVASSFCRKNKTHGGSCILINSSLEYKERDDFNFLNEELIFESCCVELEQQNIVIISIYRIPGNDVTKLFFDKFQCLLQKLTKEMRKKIIIAADFNIDTASETSISTKFNDLIQQYGFRLNFTEFTRVSDKSATCIDNILTNYTLNENAKFTLNLGISDHYALLMELLKTNKENGRKCFLKRQFNPDNIHLFCCRLNDIDWSLQHESSCSENFDRFLNSFLHVFNETFPPMSAKERQQVSNISTHVCQRKTTSKLKWITTGIKISSKRKRELHAELKSNKSPEFIKYVKSYKKLFRKVVKAAKEMANTKFIRKHKNKSKAVWTVVKSELGIKPSNQEISKLKIQDKIIVNPAQISETLMNFSTKNTRQNNCKSCSDIRNFNEFFITVAKSDVNVPSYQDNVHLFGSSLSKNECLIKFDTVTVEDVEKTILNLKNKNSVGWDEIPSKVIKAASNIIAYPLCKIINQSLEEGYFPDSLKYAEVKPLFKKGSKEDMGNYRPISSFPCFPKYLKYQKQFGFQKGKSTIYAINEFVNKVTSTLDKSQKAAGIFCDLSKAFDSVNHSLLLYKMEKYGIMGTALQWCTSYLTERKQRVVITSSKGKYSSKWRLSHRGYHKAQFVETIPQGVPQGSILGPILFLFYINDLPININYHSVLFADDTSVLIENKKADEIPDNVLKTLENLDVWFHLNGLKLNIKKLRCLKDPRKPRCLVPSKWSKIKYKKTQVMQFKTKQSKLNDIQIKHNSQELHEADHVKFLGMKLDRIYPGPHTILGNETGQNLSWSSHIDYLKNKLNSLAFAMSILANVTSLDTRKIVYRSYFESIVRYGIIFWGNASTMIRILTLQKKIIETCGAKPRESCRPLLRDLNILSVPSLYLFEIILSIIIQNYFFIITSSTVMKQEQRQFHAPTHRLNLYAQAPQYMGMKICNKLKNTHFRKVETESMKRKLYSTLVQKCYYSIDEFLNDDLSIEQDKTYNYVL

SEQ ID NO: 3006 - protein, 1071 aa, synthetic construct
  source 1..1071: note = Description of Artificial Sequence: Synthetic polypeptide
  VARIANT 60: note = Any amino acid
  VARIANT 437: note = Any amino acid
  VARIANT 535: note = Any amino acid
  VARIANT 607: note = Any amino acid
  VARIANT 702: note = Any amino acid
MLRSALTADPFTTGLHSNGQHSDRSFSRPFVFISINVEGFSREKEVLVANLCQKYSCDIXLVQETHGGSTKNRPRIAGMELILERPHDKYGSAIFARPDVNITSASLTEDNNIELLTVQTPFFCVTSVYKPPVPILASKHQPTSTIRTRQQHRTPHSANSVFLCYISLQTTCANFSIKTPANFNDQDVNFVIGDFNCRSTSWGYPDSDTNGTSLETWAEAHDLHLIHDPSSHLHLTVAGGKEGTTQTTFCFFKGSCTMYEDCRRAHPSYATQWQVEKRVQPRQHFVSSKVAAQCTKTVGEPIPRTQHRPVICTVNPVVVPEEVPFKRRFNFKKANWQKFSEELDSKVINIPPQPEMYETFIKCVQQVSRKTIPRGCRTQYVPGMSSDDKLLLETYQTLYEEDPFAKETIQAGEILLETISATRKAKWSNLVENLDMXLNSRQAWKLLKNLSGDPVKSQDNFTSMTPDKVATQLLQNGKIKGRTPKEALQRVPETEHHFLRDPFSMAELEAAISSLKMHKAPGVDDLRVEQIKNFXCKTMEWLLSLMNKCVAKLHIPKMWRKSRVIAILKPGKEPTDPKNFRPISLLCHTFKILERLVLNRISATLEXKFIPQQAGFRAGKSCSSQILNLTQHIEDGFERGEISGVAFVDLTAAYDTVNHRKLLRKVYDLTKDYQLTSVISTFLQNRRFQVSLQGKRSRWRTXKNGLPQGSVLAPALYNIYTNDQPIPANTRLFIYADDTAVAVQGPTFKEVEKKLSLAMDELSKYYDANHLKPNPSKTQVSAFHLRNREAEHKLDITWRGEQLKHCPTPVYLGVTLDRALTYRQQCLNVKQKVSARNGILKKLVGSSWGANPHLLRTSAFALCISAAEYAAPVWDASAHAKQVDIAVNDTARIISGCLKPTPVQKLYPIVGIAPPNIRRAIAADYERTKQETDHRHPLYGHQAARHRLKSRKSFLARTAPLEGAPEANRLATWKSSLPADVSPKEEIAPGANLQYPVWRSLNRLRVGVPRCKSNLKKWGILPASADTSCDCGADEDASHLLVCPLLDNTCTAQDVHEGNDKAIAAAIFWKC

SEQ ID NO: 3007 - protein, 980 aa, synthetic construct
  source 1..980: note = Description of Artificial Sequence: Synthetic polypeptide
MTSQHRTFSGPIMTIISVNIEGLSLCKEELIKDLCKKNKCDVLCIQETHRDSILNRPKIQGMRLVAERPHRQYGSAVFVKSEIQVLSTSVSDINDVEIVTVELKNCTITSVYKPPLSNFNVNATHKHNSTKVNFVIGDFNSHSTRWGYPQDDENGMAVISWAESNKLALIHDHKLPPSFNSGRWQRGYNPDLIFATESVSQQCIKTVCPPIPKTQHRPIMCQVMTAVRPVCVPFRRRYNFRKANWLKYQEILDREVAFLPPNPDSYDKFTDAVKRSSRLSIPRGCKTEYVQGLTPETVADLHTYTELFEKDPFDESTVAAGQQLLASISEAKRNSWVNLMEELNMSINSHKAWRLLKRLSNDPTSLNNHANITADNIATQLLKNGKPENRSRRQTKNMSNTTEDETNSLSQPISIDELNEAIAKCKNGKAAGLDDILVEQIKHFGPQTKQWMLNMFNKCMADCKIPSIWRKSKVIAILKPGKDINDPKSYRPISLLCHMYKIFERILQTRLTYVIEPKLIPQQGGFRPERNCTSQILGLTQFIEDGFQKKRVTGAVFIDLTAAYDTVNTRQLIEKLYEITRDRKFTDIIRNLLQNRRFFVEFQGKRSRWRNLTNGLPQGSVLAPSLFNVYTNDQPLPVNTSSYIYADDRVIAAQGQSFEDVEKSLNEALVELDSYYCRNQLKPNPMKTQTCAFHLRNKQASRQLQVRWRGVDLEHCKNPKYLGVTLDRALTFKQHCLNTKLKVCGRNNILRRLTGSTWGARPKVVRTSALSLAYAAGEYASPVWCRSAHAKQVDVALNESARIVTGCLQPTPVNKIYHLAGIAPPAIRREQAAYKERQKSIVSKWHPLHGMEPAAQRLKSRNSFLTSTEKESDYRTTVERWKDAERHPWMEPSEALAAGHNESWTTWKSLNRLRSGIARSKVNLSKWGYQNDSTLCDCGAIQTTTHMYNCPLSPSHCTFEELMSAQPNAIDVALFWAKNV

SEQ ID NO: 3008 - protein, 1288 aa, synthetic construct
  source 1..1288: note = Description of Artificial Sequence: Synthetic polypeptide
MYIFSDSHGRGIASIMQTMQMKFKVTGITKPGAPLCIITNSKLLALPNLVPLYVLLHKTDNLKQISHVSNMWQSNHQGGFQNVMFVEATSSVRTISPNMVCTGIIMAKQFCARKYDNINSQRQEIHSPIPLSLVKEKEVTSHTQNEEKEQETSLSSPKKESPLLTLKRKDNWKRSVQKEKKNHHPVLRKRTRNITVFPQKRITIAHLEKKGQLEKKRAEREEESSSCSIEEVLSLSAPEEETFSSAEKLPAKLRRGERTKKDIPLKNQDFFIPAAGEKTTRYKLDLRKTKVVPRDQLHKFQGISCTNSIGQNVMFLHINVQSLKYKINELQFWLENLNCSILSVNEHWLNCEELKLYVPFGFDLASSYYRTNVEHGGVSMLKIMTWWSVYVKNNVNLIYEVTDVSELCIEAKFEAAAIKFPKQEIIVGSVYRPPKHNESLFVENLEKLILLLLKHKNYRIVIFGDINIDIRFKNRNVNHLLNMLRSLNFYCINTKPTRQAACLDNIICNFHLNKTDFDTISLCISDHDGLWLRQTLNYKILETSTEHRIIRPINDSKLNQLISKLNIVKWDEIITNVDANEATNRFLLLLAELFETCCPKHYRKSVKQRQCSKPQNLKKTGILHITTKSKKNWYTPHLNRIRILMLLYHDKAKHNNADKEMYMKIKKLYRSEIKAAKCKANDAYILNSTNKCKAAWEIIKTEMNYDHKVYQIPISPNTLNEHFVGPHSDSSTMQDVRKAEALLPETSSNLTNNFCWSRVTEKEVYESVAKLSNSRAEDYYGLSNFVIKSVRKQIVKPLTKIINKILEGGHYPECLKISVVKPVYKKGEVTSPENYRPISLIPIISKIIEYCMHKQMYQYFETNNILSASQYGFRSRLSTTKAVESIVSKIHSSFEKKEIVCATLLDLRKAFDMVSHNILIKKTPALWSERECYMPDGVLLGEQETVSQDKKKLQHYGVRGNAICLMESYLENRKQLVKINNESSECLPVLKGVPQGSVLGPFLFIVYINDLPTVVPCDAVLYADDTTLITCDTNLENVQHNMAVAMEKCNTWFEANVLQKNDSKTEEIVFNLTAPSQDNKTVKLLGFHIDQKLNWDTHLDKLCSRLARVLHLLYKLRSSVSKELLLYAYSAFFHSHLDYGIILWGNSVGSKTVFKWQKKAIRCIAGLSPRDSCRGYYKELNIMTVPSLYIYNCLVYVKENLNNYDLRMTIHDHSTRSGHTIDVPYARLAKTHNCYKYLGLLYFNKLPKEAYTVPVDQFKNTIVKWFKSKVFYSAQEFLECGTKDLNFL

SEQ ID NO: 3009 - protein, 1030 aa, synthetic construct
  source 1..1030: note = Description of Artificial Sequence: Synthetic polypeptide
  VARIANT 364: note = Any amino acid
  VARIANT 452: note = Any amino acid
  VARIANT 487: note = Any amino acid
  VARIANT 1027: note = Any amino acid
MGQLPIHWKKTLPVKKPIRLQQDGYNRRRRRLRKRTVLIGVWNVQGLQNKVGEVIKEMEARNQDIVVLPETKKKGHGIERIGPYTHFYSGVPKNQRAKRGISILMKNKFNRMVTNWEPIDENLIKININIQEHKITLIGVYGISEDEPIRKKDEFYNRLNGVIEDIGKTREIIIAGDFNSRTGSKIGNKIIGPFGENVVNDNGNRLIDICEQNSLKILNGFYQHKDIHKYTWHKDTLNQKSIIDYIIIKQQTRIKIHDIRAYRGVTLSDHYLVNSKFLFPFRGKNSEENQNCTTEDLQTEIKITKYNLNSFENESTVFLYQKRLDEKLIETEFDNTEDQYQYIISKLHESAKEALGETDEKHTXHSLYYWDEEIKKEVKLKKEKYLKWLNTRNVQDKIELNAQQAKIRKKVAEAKNKAWEQSCQKIESYIGGKRNTEAWKTIKNLRRNSKEXTHIKYITHDSWEKYFQNLLSENRRILGKPEGILKXQHILNILLMTLGKNIFKIYYQKTEEFLGNPEYNEITNELPDNYIHLEIETVKSAIKSLKNGRATGIGGIPAELLKFGTEKLIELLRNLFERCLNGEDVPNDLKVGYISVIHKKGRKDDCKNYRGITVTNTFSRLYGRIIKYFLEQEYKEKEAEEQAGFRAGRSTIDHIFCLQQIIEKNKKLGRAQPIHLVFVDIEKAYDSVPLPNLWKALLSIGINPTIIKAIQNLYKNSISKIKIGKFLSSGFQVTKGLRQGCSMSPTLYKIYTEVTLQNWKKKCQTMGIPINDRTIYSLQFADDQLIIAQDYEDIEYMTRKLIQEYKKAGLNVNMNKTKYMVIGGINEDLILEEGMGTITTTEEYKYLGVKITNDGKQEKEIRSRINAGKTTISLLNGILWDKHITTDNKIRIYKTIVRSIITYGSEVWTTKWQLKSKLLATEMDFWRRSARISRRERIRNEVIREKMKCKNSIIEFIEHKHLKWYGHVRRMGQERLPKCILDWTPNGRRKKGRPPTTWMQEVQSAMRKNNIPEDLWEDREEWRTIIXNLM

SEQ ID NO: 3010 - protein, 825 aa, synthetic construct
  source 1..825: note = Description of Artificial Sequence: Synthetic polypeptide
MSTQFLKPVNKLTTWKSPNSTLGEFQIDHVAISNKNTKEILNVRTRKGFFESDHHLLQIKIKFQPNRKKPQMNKTFRIDPEYLKLNKKEISQEIRQSNATNWKELAEVLKSTMHLGKPPRKRKHRWWNSSCDQAIEERTQAWKTFSSNKTTEKWQEFLRIQKNTSKAIRREKRRYDINRLKEIEQEFLKNNTRNFYTIFKENLTGYQPPNLCFRRPDGSLETNTRNNCQILANIFTHSSTASRRQSNISKTPSNPDSKPPSLKEVKEIINSLNNKSPGEDGIIAEMWKLNDSTLTQATHRIISKVWETEQIPAEWKCALIHPLHKKVQKLIQITTGEFHCSQLQGNFTAPSNIQNFFKGPVKQTRRTGGPVNRRVSGRVSRSILRRTNMEPKDILQMRRCRNTVVTFVDFKKAYDSIDRQTLFHTLEEFRIDRKTRSIIQQALTGTTSKVKFMGETSEAFHIHTGVRQGDGLSPLLFNLVLEKIVRTWEKEIKGIQLGIKKEQRIRVKCLAFADDLAILTNNREEARLALEKLHEISQKTGLQISYEKTQYMENKLQIVSPSQPSMEKWHKFLTSDIKDSVHGKQAADSLPITTQYGKVAQVSHFRYLGEMIQPSGLNSIANQERVSRLQRAYKLTWNHYNKKSISVNAKLRHYNTVVLPEALYAAETTVIHGHTKIREIEKQERKILRKIYGSVFREGIWIKRPTREIYKDMETITDTIRKRRMKFYGHISRMNETRLTRQIFEIANKSKNKTKWITETEEDIKELGITQDNINNREQFRNIIKKHKLKQEHTENRTGKKWSERKREHSERMKRIWEERKKKKS

SEQ ID NO: 3011 - protein, 1046 aa, synthetic construct
  source 1..1046: note = Description of Artificial Sequence: Synthetic polypeptide
  VARIANT 279: note = Any amino acid
MCPAFAEKDAATPQPAAVALPTSGIIARATTERTKLHVAHANVQSLQAHLVEFRHIFQDLGLHIILLSETWLKPSITTSSVNLDGYVFLRHDRLNKRGGGVGAYIRSELSPTVLHTSNNDETEQVEYMFIEIKPLKEKCLICVLYKPPKVGALDCFETALSDLESTYEHIIIAGDTNINFLFNSPSCMKFKRMLTSSNLTLLQLAPTHHTADSHTLIDIFATRFPDRVIRTSQTSAPGMSAHDVIFMTYSLECPRKKPLLTTYRDLRRVNLPELTADAXEIVFEPTSDTLPDVNEKLHKITNKLNQLYDKYAPIKTKKVRRKPAPWLTDELKQLMNLRDTAHRTYKLHPTPENHTAYKQKRNRVSQAVRNAKLRYAHSLTDNINRPAVLWKNLRGLGIGKVKTAAEPTVPIEELNQYFTTPTTTIDHQTKQTLIDHITRINNANHDKFCFKHVTGSTVKKAIMRITSASTGDDGITIQMIKLIIDPLLPIITDIFNQSLATSVFPDAWKRGLVKPLPKKDIATAPSDYRPICILPALSKALEYIVHDQLTSYLTINNLLDEHQSGFRKYRSTTSALIKVTDDLKQAMDRQEATIMCFLDFSKAFDTVDFDILLAKLSSLNLSQGVVQWFRSYLTSRLQCVMSGTEKSQWRKVLSGVPQGSVLGPLLFSLYVNDVSSVLSFCKYHMYADDLQLYLSAKPKNLKTAIENFNSDLCALSKWAQNIGLKLNPSKTQAILVGHPRLINHKYRESQPSLILNDTPIYFSPSAKSLGVIIDDKLNWAEHTAAVCRKASASLHALQRYKKFFPLDLKKKLIQTLVIPIIDYSDVILQGLSWESSRRLELIMNACVRYICNIRLFDHISPSYKQLSWLRADKRRDFHTLCFLYSLINVHCPSYLSSTLTLLSDQHNRTTRSCQSKTLSVPIHHSAGFSKSFSVAGTRLWNNLPQYIRELNNTASFKRQLMDYLLKQLRQSLIPYGPGTSHPFLLPDILLLPLLSPGTAFLTSFCQNSPCLNQSRYIQKYILYLLISMLLLLLLHQQQQKVSQWYC

SEQ ID NO: 3012 - protein, 808 aa, synthetic construct
  source 1..808: note = Description of Artificial Sequence: Synthetic polypeptide
  VARIANT 274: note = Any amino acid
MVIGCFYRPPGSAAVVAEHLKENLENISSRFPDHVIVLGGDFNLPDIDWETQTFMTGGRDKESSEIVLSALSENYLEQLNREPTRGDNILDLLVTNRPELFETVNAEQGISDHKAVTASIISAVNRNIKKCRKIFLFGKSDKKRISEYLTAQHRSFISSTDSVEEQWSKFKAIVQYALDEYVPSKIVRDGKEPPWYNNRIRKLLRKQRELHCKHKHSQSLVDKQKLNEAKCSVRRAMREAFNEFESKVLCTDLAENPKKFWSYVKAVGGSKQNXQTLCDENGIETEDDTLKAELLNVFFQSCFTEEDCTVVPSLDCRTDYKMADIEIIDRGIEKQLKSLKRGKAAGPDGIPVRFYTEYAKELAPLLAVVYRRSLEERSVPKDWKMAQVIPVFKKGRRTDVQNYRPISLTSVSCRILEHVLCSSIMTFLETRNLLCRNQHGFRKRRSCETQLALFVHETQRAIDTGSQVDAVFLDFRKAFDTVPHRRLMNKVRAYGLSDQLCDWIEEFLDNRMQHVILNGEKSSEVRVMSGVPQGSVVGPLLFTIYINDLADNIGSSLRLFADDAVVYREVVTMENCIEMQEDLHRIDAWCREWQLNLNVDKCNVLRIHRKKDPLSFSYTIAGQQLEAVNSINYLGVGIRSDLKWNDHIKSIVGKADARLRFIGRILRKCSPKTKEVGYSTLVRPQLEYCSPVWDPYQVGLIEEVEKIQRRAARFVTGSFGNRESVTEMIDKLQWKTLQERRSVARYGLLSKFREHTFTEESSSILLPPTYISRRDHEDKIREIRAHTEAYRQSFFPRTIRDWNRRENR

SEQ ID NO: 3013 - protein, 777 aa, synthetic construct
  source 1..777: note = Description of Artificial Sequence: Synthetic polypeptide
  VARIANT 541: note = Any amino acid
MVSLSNYDWSHIFNNNAHDSANTFFDRFFHTFLNIFETNCPQYKCKVNPKSNSNKHRDKNPWYTAQLANMKSRLLLYRDSYRLQKTDMAKQRYSRAQKDYKHAVNEAKKQHNLVSIESSKNKCKKAWTIINSVSKSKQKVDVVISADEFNNFCIKSVNQISENIVRPHETVADLIKCHNVNYTLKDKFLLSEVTPDVVLTIVNNFRPSDSVDIYGISCNMLKKIIGYIVYPLTKCINKCLIEGVFPDVLKLSRVVPIYKKGDRNCPSSYRPISLTPILSKFVLESIIYYQLCDYLTCNNIISAVQFGFRKGKSTVHAIDSLIKKVLNAYEEKKFAQATFCDLSKAFDCVEHISLLKKLVYYGIINSEVDNIFESFLSNRKQIVCIGKQRSQLAEVKCGVPQGSVLGPLLFILMINDLPSYINTHSFSMPMIPLFSISAQTLICFKLFTILYKYSLILYADDTTFFNISSDFDMLQTVTNDTLSQASVWFRANGFLLNESKTQKIVFSLRDLPVEDFIDSVKFLGIVIDSKLSWEPHIKYIXTRLSRVVYLLRNLKNHVPAAYVRSAYFAFFQSIISYGLLIWGNSSHVQDILVLQKKVIRIITNSDKLAHCKPLFINLKILTVINLYIYTALLHIKSNLSEYQRRGDVHSHGTRNSSHLDIPYYRLSKSLNSYEVVGMKMFNKLPQEWVEAPLDLFKHKLYCWLAANPCYSLNEFYECKISWYLLGECTIISLMESFMMQCFKLYYFKYLILWKTYSDLLIFALCKVICIYALPYVK

SEQ ID NO: 3014 - protein, 1754 aa, synthetic construct
  source 1..1754: note = Description of Artificial Sequence: Synthetic polypeptide
  VARIANT 825: note = Any amino acid
  VARIANT 1543: note = Any amino acid
MAPTVQPSSVGPKGHQTHSASLKVGGPSFIAPPVPWWGGNTSPPPSGTQVPIPQPEKQQPSPAPLAREEKSVGMLPSPVSKSRLEDPSRSLGDAHTTGRRASRSSSAPETSEKPSQWSKPKEQREDKQKKKRSKKKSLPTALPPSVSQTSDSEDGLEMLASPEDLALTDLPESMDIDATSTKAAAKGDTEAGINSMFMTLMASQYANSNILQWNCGGYFHRLAELRHLLCQFPVLCVALQETWFPVQRIPALRGYRGYYKNRAAYDRVSGGVCIYVLANVPSAPVPLHTALEAVAVRIRAGQEITICSLYLPPDKAVSSAELAALVAQLPPLYLLLGDFNAHNPLWGGTEITARGRDVEYLLAQLNICLLNNGAATHFSLAHGTYSAIDLSLAVQAYFHTLLGGSMTTFVEATISLSCRSHSHHLQAACPDGHSVGQTGRLTPRLLQQRSRHTLQLGPWHLLSHRSVPCSPSLLPHLTWRVHDDLCGSDHFPLLSLPQSPPAGCLPRWSLRRANWPAYTSAATVTSPLPDDVDLAVDDVTRAIVSAAEATVPKSSGLLHRKSVPWWTPEIAEAIRERRRALQRHRRHPSLEHLIAFKRLRAQARRLIQQSKRDSWERYAATIGSRASPTZVWKQVRRLFGHRPLAGIPSLHIRGTLSTDPAAIAQYMADIMLVARHLHLTVRTSAPSKSVLNSGSFPFTCAARKNTMRHSVSGSLRVPAPFRASSTGRNPQSSHSGYSVHRPSCYRAVHGRHYARSSASASYSADFRALKERVEQRQLSFHMRRQEKYNAPFSEWEFESALAACPDTSPGPDSVHSQFVRHLPAXFQQLLLALYNHLWVKGAFPSQWRDSIIIPVMKPGADPQVAESYRPISLTNVLCKIFEHMVSRRLMWILEDRGLLAPQQGGFRHGRSAIDNLVSLESAIRTAFTRREHLVAVFFDLRKAYDTTWRHHILATLYDWGLRGPLPTFIKNFLSLRTFRVRVGTSLSTHHIQENGVPQGSVLSVPLFLVAINGLAAAVGSSVCSSLFADDFCLYYSSASIGVTERRLQGAIRKAQSWASAHGFTFSASKTRVMHFCRRVVHPDPELYLADEQLHVAETHRFLGMLFDNRLTWGPHLRQLKQKCWRHLNILRCLGHTAWGAGRQTLMHLFKALILSRLDYGSQVYDSASPSALRILDPILHGGVRLAMGAFRTSPVPSLLAEAGIPPLRFRRQQLLASYVAHVHATRLTIQIAGFCFQTPSFPLHNIDPDQVFQSRSGYVLSFPHSSPYLYLPHSPANLISLLGPSLAYSSTCNCPAIQRRRFHHIHFINSFWTSLARSVMQKSYTLMAPRSWHPSPEVSPATVVGFICRPRSCYTPHHPNRRLLFPNTVLPSPQHRPRSGLPIAVRVRTLLSSLESLPLPPAFSCQSHIPPWSIPRLQLHLQLSCDPKASVSPHTLHQQFLDILGTFRDAEVIYTDGSQVEGRVGYAYVHGDHIEQCSLLPGCTVFTAELIAIIRALDHLRTCPRKSYVICSDSLSGLQALDQCFPKHHLVRSIQDSVFSLGXSGRSVAFIWTPGHIGIPGNERADQLAKQAIASQRLDIGTPERDIRLGLHHKISMAWNSEWSTLSTPNKLCAIKPSTAAWKTSLRPSRRDSVVLCCLRIGHTWLTHGHLLHREDPPNCRCGALLTVVHILLDCPLLAALRQSFNLPSALPSLLADDASMVDRVLGFIRAAGFYHMFNGGYLTFRRPPLNSFNLLFLLSCQSYFQLAALVCTG

SEQ ID NO: 3015 - protein, 848 aa, synthetic construct
  source 1..848: note = Description of Artificial Sequence: Synthetic polypeptide
  VARIANT 183: note = Any amino acid
  VARIANT 301: note = Any amino acid
QWNKVRQLFHFKGLYISSTGFERKNIYKGTWISPDGRTVNQIDHVAIEDKLKKWITNVKTARGQSVVPITFCSKNSKGAECGSDHFLLKIDLRVGWKPKLTKKLQKVVHFDYNKLVTDEGLQDNFRINLIVLKPWQHCYRNPGNIATDSLDAGSLWEGIRDLTETAKEVIPKRMNRKKVWFDXECELAILERQRAKQVWIQSARGRYEEGKERFDEARRRTQATLRRVKRNYFKNIMVEAQKDFHGNKSKELFRKVKAIKGEGKKHGFIKDRNGRVLTNNNDIAIRWMEYFDELLNCEEPXETLEFEEPVTVDPEYPLQHSKKGTCNCGSGIPPPTFEEIKKNIKELKNGKSAGEDGIVAEMLKSGGDSCIQNIHKLVRKIWQEEVIPEDWKVALICPIHKKNDKMLCDNYRGIALLNISYKVYSKCVLLSRIKPLAEELIGEYQGGFQPGKSTTDHIFFIKQVCEKMYEYDKEIHLLFVDFQKAYDSIHRTSLFKALIEFGVSKKLVRLVSLCLDDTRAKIKLGNRTTDSFRVTTGLRQGDSLSPILFNLVLEKIIREMDSFNHQGIQVANRNITHLAYADDIVLMTHTKENLKCNANDDHGKHSKQIWTESEPHKNQIHDSWKSPTPRNPGINCGNNTYKRVKDFKYLGSIISENSSSGMEIKARIQAGSRCLHSIHNILTSRSISRALKLRLYKTLILPVILYGCQCWSTRKQELNRLAVFERRCLRKIFGPVKDNITGEWRRRHNIELEQLYSEPNIVGLMRSRRLEWAGHVVRMSEERWPRVAMEMIPTGKRPLGRPRKRWMDGIREDLQKLEAWKNWEQTAKNRNEWRALIISSRGPLGLIA

SEQ ID NO: 3016 - protein, 1416 aa, synthetic construct
  source 1..1416: note = Description of Artificial Sequence: Synthetic polypeptide
  VARIANT 355: note = Any amino acid
  VARIANT 420: note = Any amino acid
  VARIANT 424: note = Any amino acid
MAPIEKCSGTVLSSKRQKISSSSCKECEKRVMKGIMCVKCNYWLHEKCAKINLKYISDDFPWTCHACLSVETADLVSLVESKNEIIKLLQNDIEALKTEILCLKEENARLLQEKQCTVGEIHQEKQQDCANTCAREIQQTKKETRENTYARNTDVVNENISSAVDVTVNPTCKKPADKYKWKLVTYSKRKEKTTARPTQEDENEFLIIGDSLLKNVAVPNSKIDVRPGIRTQQLGKHFKNLENAKSAEPDCEPKHNYRGVFVHVGTNSLRSSSEEEIINDTRNVIRSARSVYARSKLVISGIIKRRSVSDKYISQINCAIKEQCDSLGAIFIDPNKFLCENCLGKDGLHLNRLGXVTLSRMFTDVCKIIRNEGNGKLRWTDGGDKSDILAEKANFKHHSKVKEIQNRIPEQMPQHLSQQXENYXKVLHQNIQSIGNKKLEVEILLSELQPDILCISEHGLTENQIDNLKISDYTLASYFCRSKQKSGGVSIYIKTGKLETANNKGVKLPTVKEKDFEITGVMIEGLSVFCVYRSPSGDISIFLKKICMNMKRNIIICGDINIDMGKGSKIRQDFEELLLQYHMEATISTPTRVTSHSQSVIDNIITNISRSDYESHVIQTAITDHDGQMFYLCRRHGRACETKAKIKEIRVMSEQNINTFRTILSRETWTETLQAQTVNEKYDAFIATIKFHFEVAFPKVKRQIKVQQQQQWITREVLEQRRKLQELRQVGDVEGYKTLQKTYRKTIRKAKANSINITILNSKNKIKAAWNVINTERKENAGPNKETEIRSMKIDNRIVTDGSKIANILNDNFINVVENLKLERKSPKKKGTKVTKYSYSTMFLRPVTEDELRKTIQKLKAKKSAGDDEISNHVIQLVSEQHTHTISRYSKQLFQRWNFSREIEDKVSNTLTPLVDIANSSFRDGIFPEKLKTSKVVPVYKKGNKDDPNNYRPVSLISGFSKILEMLMYNRLVDYLDKHNILVPSQHGFRMGKSTESAIASLTEYVIQCLDEKRVVAAMFLDLSKAFDTIEHDILIKKLENYGIRGLSGEWIESYLCNRKQYVSIGNSFRSETKTIKYGVPQGSVIGPLLFNLYVNDIGGEEKEKKILYADDMTVLNHGQNMQQLERSAFISANTTAQWLTENELVINLKKTMFTVFRNKEKSVQMNLKVNDMYLEEVESTKFLGVIVDNELKWKEHINYVCKKLSSVIFIMKQLSQYADKQLLCTVYHGLFEPYLQYGVTVWGNSNIQETKKIVHFTKESNQDHTKKKELGDLQCGETQTSKKRKKLFTLQKKAIRIILRRKNSETCRNCFKSLGILTFTSLYIYKTIMYITKEISLYDTNASVHTHNTRGKNEIRNIPHRLTILEKGPRYSGIKFLRNLPKNLRDNIHGNNFSRKLKDYLMEKEFYSIEEYLLN

SEQ ID NO: 3017 - protein, 939 aa, synthetic construct
  source 1..939: note = Description of Artificial Sequence: Synthetic polypeptide
  VARIANT 90: note = Any amino acid
  VARIANT 272: note = Any amino acid
  VARIANT 662: note = Any amino acid
MDLVLERPHTKYGSAIFVKSGLSIQSTGLTSENDVEILTVGFQSCTVTSVYKPPNAEFKFVEPLNFQSQPIKVVAGDFNCHSTSWGYREXDKNGEDLEAWAEQMGLVLIHDPKLPSSFNSGRWRGQYNPDNIFVSNHIAQQAKKGVLGPLPHTQHRPVTCTVAAVVKPETVPFKRRFNFKRAQWEKFSIELDKEVIKLEPSPEMYDSFIQLVRTISRRNIPRGCRTSYIPGLDKDSKSLLQKYEHLFETDPFSEETTQAGEELLNAVSATRXQKWCDMVTQLDMKQNSRKAWKLLKRLNSDPTSAPPSLVNVTPDQIAHQLLLNGKTKRRTAAKKFQRYTDEEDYLGTPFTIEELEVVFKSMKNNKAAGLDDLRPEQIKMFGPVTKQWILNLLNNCISKLQIPKIWRKAKVVALLKPGKEPTDPKHFRPVSLLCQLYKVLERLILNRISEHVDKNLINEQSGFRPGKSCCGQVLNLTQYIEDGYERGQVTGVAFIDLSAAYDTVNHKKLMRKVYSVTKDYRLTQFIQCLLQNRRFFCNSAHSSSSVCCKIGGFFVTLHNKKSRWRTLKNGLPQGSVLAPLLYNIYTNDQPISSEVRTFIYADDTATAAQGKTFEEVEMKLTAALEDLGKYYDDNHLKPNPGKTQVCAFHLRNKEARKKLKIXWRGQQLLHYDTPKYLGVKLDRSLTFKDHCQETKMKVSARNSIIRKLTGSTWGSQPSVLRTSALALCFSAAEYAAPVWRNSTHAREVDTALNETGRIVTGCLRPTPVRKIYEIMGIAPPDIRRRTAAETEKKKQETDPRHPLFGHEPRKPRLKSRRSFMSTTTSTALRPGTRRTELWQNSSNERAGENIKEEPAEGFHLPYATWKALNRLRTGVSRCKTNLRKWGFTNEDELCECGDVQDPQHLLVCRNLPNPCTIEDLHAANDVAIKTAEFWSLRSI

SEQ ID NO: 3018 - protein, 1773 aa, synthetic construct
  source 1..1773: note = Description of Artificial Sequence: Synthetic polypeptide
MKRVKLDNGRDTAVSEGRKKNNAPSYDKRTFPSLSTPWEEGQARRLGVKPFPRYLVCTRTDGGTFTATKPLFFVEHIEDKFGEVETMSKMRTGSLLIKTVSAAQSAALCACDHLGDVPVSITPHQSLNMVQGVIFHRDLLLQTDEELRANLERRGVHFVRRVQRGPKDHRVDTGAFILAFEGDTLPEKVKVMIYHCCDVKPYVPPPMRCFRCMRFGHMSSRCTAVPVCGECGRPLHEGNPCVPPPVCVNCHEHHSSRSPECPVYKKEKKIQEYKSLDRLTYQEARRKFERLHPVQLSTSYASVTSFTPPPSSSHSHPILPPPPPAPPLPPSQRPPSSSQPEKCSPSLALAGEGAPSQGSSSRRPPDRRSSASSRQPDIQADNTKVARSSSVPDLTDSSSLSGTCPSRPAREKEKEKRKKKQKSQDKAPPVVLEAPPLSSQPNNPTELVSDPLFMDVVPPSSVTDVDPALPSFVTCISPFAFHMDPRSVLIQWNCNGYYRRLLELKHLIASYSAACVVLQESHFTDGHSPTLRGFRAFCRNRVRPLQASGGVCTLVRTDVVSSWIPLRTTLEVVAVRVHLHTPLTICNLYLPPDRPPTSAALTALLQQLPPPFLILGDFNAHHLSWGSAYTTSRGRLVDQFIADHDLCLLNDGSPTHFSAAHGTFSSIDLSLTSPPPPFSLSFAGHRMTTFATVTTFRCRSRHLFLHRPFTHFSPPPLFPFFRWSPHDDLCDSDHFPLILSLPSHWTRDRIPRWVFRHADWPLYTSQVVFTPSPSDSIDEVISDVSNAITRAASIAVPQSTGPPRRRPVPWWNATIASAIRERRRALQHLKRHPSRAALVNFKRLRAKARYIIKQSKRVCWERFLSSLGSSVPLSRVWAMLRSIQGCQRPSSIPGLALPDGVCTDPLVIAEHLAAHFAKASATASYPVAFRLKKQQAEASNLCFTTHREEPYNKPFTEWELRLALSSSHDSAPGPDSIHNQLLKHLSPPQRQYLLQVFNHIWLQGVFPSQWRDSIVVPVIKPGKDPSSLDSYRPISLTNVPCKLLERMVARRLCWVLESRGLLSPYQCGFREGRSPIDHLLRLETAIRKAFSKRQHLVAVFFDLRKAYDTAWRRHILCTLHDWAYEAPYQFLSVSFYPAACSVLGLRGSLPIFISQFLSRRMFRVRVGSSFSSPQIQENGVPQGSVLSVTLFLIAINGLVSSVGSLVTPALYVDDFCIWYSSHSVASAERQLQGAIRRASTWALSHGFQFSPSKTRVMHFCRRTTVHPDPELFLGTQRLEVVAQHRFLGLLFDKKLTWLPHIRQLKISCMRKLNALRFLAHSSWGADRTTLIHIYRALIQSRLDYGCQVYGSAAPSALKLLDPVHHCGIRLATGAFRTSPVDSLLAEAGIPPLQTRRHQLLVSYAIAIRKFPGHPTYHVLFEGDGLRTPDTRPRVGLPVGLRLASLCRDFNLPSLDCMRRAIPRTPPWLVPRPQIRLDLYHAPKASVSPIIFRRLLHTVLEEFQGATIFYTDGSKFAGHTGYAFTSPIGVECHSLPESCSVFTAELTAISRALHFIKQVALDRVLICSDSMSSLQAIDRCYSSHPLVIDIHDLLADLRRTACSVAFLWVPSHVGILGNEQADQLARVAVTPCPFPWVIPGADLRVQMRSLLIQDWNTNWQATALSNKLRSIKSTTAAWSSSLRPSRRESTVLCRLRIGHSRLTHGFLLRNEPPPHCGCGALQSVAHILVECPLLLALRAKYGIPHSLPSVLANDSRIADRVLGFIRESGFYSRL

SEQ ID NO: 3019 - protein, 969 aa, synthetic construct
  source 1..969: note = Description of Artificial Sequence: Synthetic polypeptide
MDNYRILKGRPAIKVKKTEKTKNVVLILGTAFFIHNSITESIVEFRSPSPRLPVVTLASGNKLYTIFNAHAPINEDNRKNPEKVEEFWSQLEEELFRTPDKHVKILMGDFNAQIGKERKFRNIVGKYVAHRRTNRNGERLIDVCESFGMKIMSTQFKRAPKQMKTWRSPNPMLGEFQIDHVATTSPKEIMNVRVQKGANFDSDHYLTRVKVKPIPGNRRRKTPRIQKYRIEELKISEEIVVKYQHELDTLNSNEWDKMAQKIQEAAKQTIFLAKKKKHPWWDDECEDALRKRSEAWNKWNSTKQNFEEFKTQRRTTAKVFRNAKRKFERDQLKELEENFQKNNTRSFYQTFKSKLRGYSSPNICLKMIRANRLLITQHLFKNDQGKLIMNNKHNCEHLARYFKELLNCDPPPEKLTFQKPQNKLPDSTPPDKKEIREIIRGLKNNKVSGKDSIVAELLKYAGDSFLERLERLFQKIWLTGEIPEEWRDAVIHPLHKKGDKSNVNNYRGISLLPVAYKILAIALKHRIEQHIDQQLGEYQAGFRTGRSCAEQIFTIKTLIKTKALAADKKVIMTFVDFKKAYDSVDRDTLIEVLKEFGIDDKTTRLIQQTLTNTRSQIKFLGELSEPFEIKTGLRQGDSLSPILFNCVLEKVIREWRKEMSQFNFPNGIRLGRKQSGLTFECLAFADDIVFFAENLQIATKQIEVLKETAVKAGLQISFEKTQYMNINATDPVWTMRTKYGDIKRVQRFKYLGEILTPNNNEKAAIEERARKMEIAFRLCQNTYKSKSLSYQAKFRHYSSVVKPECLYASETIARKGLSDLEKKERKFLRKILGPRKISNEFTFRLRSNQELYQRFENITTTMKKRRLSFYGHIKRMKSERLANKILLFQENRKTQVPWVKEVHRDLEKCGITAEEIVNRQIFRKKVAEVKDFFEEKTRKNRVFSAEERARVSQRMKEYWRKRKEENFRK

SEQ ID NO: 3020 - protein, 981 aa, synthetic construct
  source 1..981: note = Description of Artificial Sequence: Synthetic polypeptide
  VARIANT 355: note = Any amino acid
  VARIANT 557: note = Any amino acid
MMKGPFSEPCLTAISLNIEGLSTEKEQLISNTCKLHSCDVLCLQETHRGPSQRRPRIPGMILVKECPHDQYGSALFIRPGIKVSNIRFNTVNNTEIISVIIGSITVSSIYKPPGERFAFSQHVCHPQLVMGDFNCHSKVWGYQDTNEDGELLESWAEEQELNLIHDQKQPASFNSARWKRGYNPDLIFVSKTLSGSCNKFVLNPIPKTQHRPIMVKFRPVIVPQEVSFKRRFNFKRANWKKFADILDKEIVYLPPNAENYEKFVEAVKRSARLSIPRGCRTLYIPGISNKMKQLYNEYIEQYNHDPFSVETIKLGEQLTETISKDRQESWKHMLESLDMKHSSRRAWNLLKRLSXDPAAPKDQVSVTANQIAHQLLLNGKPTRNSKIVTSYKRPQVDEIPPVPYFTSIELETAISSLKSRKAPGPDDVVNEFIQNIGPIAKEWLLQLYNFCWANKSVPKLWLKAKVVAVPKPGKSRDDAKNYRPISLLCCPFKLYERLILNKIGPQLESQIIPQQAGFRPGKSCTGQVLCLTQYIEDGFQKGEKTGVVFVDLSAAYXTINHKILLENFSKKIFQNEGNYHLTEVVRSLISNRRYYVEFQEQRSRWRNQKNGLPQGSVLSPLLFNLYTNDQPAGPDARSFIYADDVAIACQSRSISHIERNLSDALEVLTEYYNRNQLRPNPAKTQTCLFHLNNQEAKRELQLEWNSVKLKHCPNPVYLGVTLDRTLSYKSHVEKTRAKIYTRNGIIRKLTNSHWGANPEILRSSSLALCFAPAEYACPVWRRSTHAHKLDTALNDSCRLITGCLKPTNRDLLYMCSGIAPPQIRRQTWRWLKEADSARIEDIPCSDISQWCKIKIEERFHFEHPLNESQSTTRESMWTQKLEKKKKKNSLQCWNIKEKLPAGSQLEWRVWKSLNRLRCRMGRSKDNLFKWGYAEDELCQCGEKQTMTHLLSCPSLPAPCTFQDLWLANDAAVKCAEHWREI

SEQ ID NO: 3021 - protein, 1210 aa, synthetic construct
  source 1..1210: note = Description of Artificial Sequence: Synthetic polypeptide
  VARIANT 85: note = Any amino acid
MPRKFFRPKMFTHGKPHETVLQVPPNNRFSVFEENTNTVDSFATVLNNERVSANTSRKIGKKCVKVNIHADSHGRGLAKILCEDXDVDAYSYVKPGAPLYEIGKNIKDGSPMNSNEYTVIVGGANDVYKNELSSAIQNLNIILESNNSNAMIILGIPHRHDLIYESCVNKEIAKANKQFENICNLYPNTQFLPIDFLQRDSFTRHGLHLSRKGKKLLCFKIAEMVSANTKKGSNSQKTVQTSVPQQPTQSPSAQLYNINATTKTPTDDPILPESTNSPPSVDSIEPTSVAAMPGLIVDTTVTPASHQEEDIWASRIVPEPMEEASSTPEDSSQLLKIQGFFMVSSQGRKNSVIATPPSKPNVNTKREINPINHPKTLVSVNKLTVFHQNIQGLRSKLDEISINILDKDCIDSADVICFSEHFMKLDTDSLQLDSYNLAALYCRQSLEKGGVVIYVKNKIVHRSLDLSDYCIDQHCEVCGVVISTNLSEITVLSCYKAPAGKICIFLKQIVSVNSYFLQKQRILLIFFAKTKNIIVLGDFNVDYLIDNMGKNDLSHVMSSFNLTAQVDFPTRVTANSISRMTISSPNDNIFLDKSRNPNTIVKRVLNGLSDHDGQLLSIEGVGPLSKNKSYSKTFRAINSQSINTFCDLLQETDWDQIEHLDNVDDKYNAFLNEFICLFEAAFPKRTAKPKHETYCHKNWLTRGIKTSCRRKRNLYASLKSCFSLEKEKHYKLYCSILKKVIRAKSNSIKSEIDVSSNKIKTIWGIIKRETGKIPITENSLEIKKMMSFMIMLKKNDVIHDNVEIITDIFNSHFLSSAAQTGKTCSINEAMLFLQKSIKKQSKLTCLLSQCMKLRLKTKQINMSPVTVHEIEVIIKEMKSKNSVGIDGISSRILKHCYKPVSKILCHIFNKSIQQGIVPERLKYAIVKPLFKKGDKTDVTNYRPISLLTIFSKILEKLVHKRFIDHLTQYKLLNSSQFGFQKGISTDQAIFSFTNQILESFNNKLSPVGIFCDLSKAFDSVNHEILLEKAKHYGFIGSAGKWIKSYLTGRKQKVMLNNSEGHSVSSSWGSIGCGVPQGSVLGPLLFLIFINDLPLCTSLKTHFTLFADDTSILINESSNYNLEESANIVLREALNWFVINGLALNANKTQIIHFQPSKKMEDPITIKCNGTDLLQAESTKFLGIHIDSNLKWSEHILQLHKKLSSATFAIR

SEQ ID NO: 3022 - protein, 769 aa, synthetic construct
  source 1..769: note = Description of Artificial Sequence: Synthetic polypeptide
SNRAKNICAQASKALLRERIRHIRSSLDSSNRKLIELHLALSSKLAEEDWEKVDRLTFQQAERTNDSVATRQMKKFDNLQQKTTGNGQTMDTQRTVVNLSSHELSDAATQILSKGMNFAITPRRVPKEDIIESVEASLRHLPQAEAEKIRQETVRVLAHAKPPKQNISNEERRAIIELKNNPDLVVVQSDKGNATVVMNTTDYDDRMEKLLSEPIYKKLKGDPTAKVIKQTQALLKKTRMNFDTARRLNPQVPQAPRIYGVPKIHRESFPLRPIVCSIDSPTYRLAKELVPKLQHLVGHTDSYVKDSTHFVALLEEKRISTTDLMVSFDVKSLFTNVPVSDTMNILEERVPPDVCDLVQHCLTTTYFRWKGEFYEQTDGVAMGSPLSPVAADIFMEAFEETALQSAPLRPDCWLRYVDDTFVIWPHGEEELQNFHQHLNQQHNKIQFTMEIEKNGVLPFLDVEVYRKPEGKLGHRVYRKATSTGRYLHATSHHHPTQKKSVLHTLTKRAHRISDEQHLKAELQNIRSIFEANGYGKRMIEQTMTSNDGNKREEQKEEQTIALLPYVKGVTERVGKILRREGIKPIFRSNNKIRDVLGSMKDKTDKLHTAGVYEIGCECGQVYIGETGRPINTRIAEHERYIRLGQHTKSAVAEHQEECGKQIGFQEVTVLAKQPYTLKRKIREAIEIAKRPGNMNREDGYRLPASWLPAVAALRDDTARSAVHRGPHSPETTAAARTQSKQHALAGARHQCYVTATTAPHSPVSTNGKH

SEQ ID NO: 3023 - protein, 1361 aa, synthetic construct
  source 1..1361: note = Description of Artificial Sequence: Synthetic polypeptide
MARNCDCCERMEAELVTLRSQLQAALASLATLETAVGGRRCCGPLAGVQQTPCASVVPSDRPAAVASPLTAREGVAPQSVVDWEVSSARVRRRKTSRGTEVEASPVSLANRFEALSVAEDVPDADGVACPVLAPLPSRSGHSQRVGLLVVGSSNVRRVMEPLRKMAAREGKKSNVHSVCIPGGVIPDVERVLPDAMKSTGCSQLQVVAHVGTNDVCRFGSEEILSGFERLSEVVKTASLACKMKAELTICSIVDRTDCGPLVQSRVEGLNQRLRRFCDRVGCRFLDLRQRVVGFRVPLNRSGVHYTQEAATRVAGAVWRGLGGFLGVRSPLYSGSGYTGSGGCVAWTGRFFRLEGLGNTQNGFQSQRGQVRHRKKADLGTIGVTVVNCRSCVGKVPELQALIESTEAQIVIGSESWLTPEISSAEIFSKGQMVFRKDRINKKGGGVFIAVTNGLSCSEIEADTSCELVWVEVIPDNRNKLIIGSFYRPPDSDDAVAEMFKESLNHISNRYPKHTVIIGGDFNLPSICWHNYVFKTGGKYKTSSELVLNAFSENYFEQLVHEPTRIVSGCENTLDLLATNNPEIVKSIKTDTGISEHRVVVARLNVEIPKCTKNKRKIYLFNKADKNSLHAFLSDSLQSFKTKNASVDQLWLTFKDIISVAIERFIPNKLIKEGADPPWYTKQVRSLLQKQRKTHAKFKKTQNPQDWQSFTETRNLARTSMREAYSSYHNEILSRNLAENPKKFWSYVKYTSGKTQTIPSLRDSNGNTTDDSTAKAELLNTAFRNSFTKEDEVNTPVFNPRTAASMRNLEVDVPGVVKQLKSLNKNKSSGPDCIPTRFLSEYADAIAPYLAIIYNRSLSERSVPKDWKVAQVTPIFKKGNRSDPQNYRPSHSPKLQAISLTSICSRILEHILCSNIMNYLEENDLLTNSQHGFRKYRSCETQLALYSHEVLSAIDKGSQIDSIFLDFRKAFDTVPHKRLLMKLRAYGISPQLCDWIHDFLSERTQFVVIDGKSSSKTEVISGVPREALNRSDIWRSQGSVIGPLLFLVFINDLGDNLNSSLRLFADDAVVYRLVKSTEDQKQLQSDLDKISTWCENWQLTLNKEKCEVIHMTTKRNPLNFNYAINQSNLKVVNSTKYLGVTITNNLTGENTGRKFYQIPRSYNYEQLDWREHIENIVGKANQRLRFIGRTLRRCTSSTKETAYITLVRPLLEYCCPLWDPHQVGLTEDIEKVQRRAARFVLSRYGGEASRKCCTNWGGNHEGSEKGSSFCFITLRGGSVTEMLHELGWKSLKERRYSLRRDLFAKFQSPTFTSECENILLAPTYLGRHDHPNKIREIRSKTERFRCSFFPRAIREWNGREKL

SEQ ID NO: 3024 - protein, 981 aa, synthetic construct
  source 1..981: note = Description of Artificial Sequence: Synthetic polypeptide
  VARIANT 428: note = Any amino acid
EQQCMPQGTCSDDQACPHKSWSVKSQPSFLTTGMNLCNYKPVQRLEVKDCGSMSFFHLNIQSVRNKLPELELFLLEFQCDILCLMSTGHTLSNEHWLKEHEHNMYTPLGYKFLTGFFRSNIEKGGVSILMKNDLNCKIRIVDLKHLASEGQIEIAAIHLPPSADTLKSHNFSCLNDKPTRQNACLDNVISNLSRDDVNLNVVKPMLSDHDGILLKLIVPKKDHRPTQPIVNRPVRQLKPINITNLTQRLLTFDWDATVMENTTLNNAFDYPPQLIIMLLIIRPNLFNEYCPPPPSTKVKYKEETKEKLTMVHPHLNSLRILLKIYYEKSCTDSEYRHSYNKLKNIYKKDIISAKKEANGTYISQATNKCQAAWKIIKAEAGLQVVNPPIPRADELNKNFINSGQSAIDHSNLDDNADSFLSSLETELXVDKLKFRWHAIYPKDILDVARSLSNSRTEDIYGLSNFTIKRIIEAICIPLCQLINRMFLEGTYPDCLKQTIVLPIYKKGDRTSPQNYRPIAIVPITSKIIETIMKNQLNDFFCNSLLNKAQYGFRSGLSTVKAVQEVVHSVLHGFENRQHSYATLVDLSKAFDTVSHGILTKKLETYGITEKELALLKSYLANRNQMVLVNSTNKSDPLKVQYGVPQGSVLGPFLFIVYVNDLPNLLPFKSVMYADDTTFITSHNDVNAVKQMNNSMMEKATQWFQENRLTLNNNKTEHILFSLGNINNEQNHPVKLLGIYLDSKLCWNTHTEKLCSKLARVLYLLRKLKDCVSKELMLMAYYAFFHAPYIMEYFFGETPLERKKSSSGKRKPSDAFLARTHAYGILCFFPCTLHYGILLWGNSAGAKEVFLWQKKAIRCIFGLSKLTSCKQYFVQHKILTVPSLYVLKALMHARQNVDEYESRSDVHLYGTRNRNLLDIPWARLSKVKNSFLHMAKIFFNKLPYNIRELHENKFKIVIETWLKEKALYNTNEFIWTENKSCY

SEQ ID NO: 3025 - protein, 555 aa, synthetic construct
  source 1..555: note = Description of Artificial Sequence: Synthetic polypeptide
  VARIANT 315: note = Any amino acid
KLLLNAVIQLLRKGLHYEIPRESGIVVLKADKGNSTVLLPRRLYLEKMYGLLSDTMYRKIEHDPTARVQRKTCTLLNSSSLAPETSSGPYSTCATEDVHTFEFFLVSSRDIKRLRPHGSVPPRLYGLPKVHKEGIPLRPIVSNIDAPTYDLAKHLASLLRPLVGKCTHHIRNSADFINRLGALHLSSSDLLVSFDVVSLFTKVPLADSLALIGKRFQSDITGLFRHALSSTYFMFNQEYFEQTDGVAMGSPLSPLVANFFMEDFEERALESAVCKPTVFWRYVDDTFIVWPHGEDKLMEFLHHLNSIHENIRFTXELEKDGCLPFLDVLVKRKSDGSVGHSVYRKPTHTDSYLHSSSCHHPSQTMSVLKTLVHRAHTVSDAESLPKELAHLRTVFRDNGYSTRQINRAFSPKTRNREVDKEENAPAKSLAFLPFVGNVSFKIGRILNNYQVKVIFRPPSKISTCWDQDFDLLGSVKDDLLLRKAGIYKIPCECGMAYIGQTTRTWKNVAQNINVALAFCNPASLQLRSIVFPTDIQWSMIKHQFWPQQHPSGTPL

SEQ ID NO: 3026 - protein, 487 aa, synthetic construct
  source 1..487: note = Description of Artificial Sequence: Synthetic polypeptide
VLCHIFKLFEKVLHDRLSKAIDNYLIPQQAGFRPGKSTTSQVINLTQLLEDGYENRKITGVAFIDLTAAYDTVNLRLLMKKLYAITRDFKFTSIIRSLLQNRRFSVEFQGKQSRWRAQKNGLPQGSVLAPLLFNIYTNDQPLPAGTENYIYADDRAMAVQGDSFEEVEKRLTDALDALCQYYADSQLKPNPSKTQVCAFHLRNKQANRKLRVSWKDTPLEHCANPKYLGVTLDRALTYKQHCINTKMKVSGRNNILRKITNSSWGAKPEVVRTTALTVCFSAGEYASSVWYNSAHAKQVDIALNETCRLVTGCLKPTPIDKLYHLAGIAPPAVRREAAAYSERARAELSESHLLHNIQPATRRLKSRRSFLRATDNLSDQPGSRVDRWKRSRERHWMEPKEELAPGHNEDWTVWKSLNRLRTNTARSRDNLMKWGYSTVSNLCDCGDVQTTQHMYNCPECPSHCTLEDLMLATPNAVDVARFWAKCI

SEQ ID NO: 3027 - protein, 937 aa, synthetic construct
  source 1..937: note = Description of Artificial Sequence: Synthetic polypeptide
MDRRKVKILGLSETKWKGSGKKTLRNGYILHWCGSQTETRNGVALLLHKDVAIHTDIRYVSDRIIQMKLHVDNTYITIFQVYAPQTGCTADEKEQFLENLEDLIVEDNVIIMGDLNAQVGKERQGCENIIGPHGYGKRNPEGEQLLDLCVRNKLIIKNTWYQKRESHKITRYSWDGQHKTVIDYIITDQKASQTVKVIPSECMDSDHRLLTADLKNVRVPLVKYKKMPKIKTWLLRDPEKKQEYQKKIKDRIPKTEKLGVEEEWKLFKDTLVTEAVHICGKTSAAQREKETPWWNDRVKTAIKERNVLKKKLDREKQNRVDVRNDTEIERLSQEYRNKKLAVKRLIQNEKDKCWDDFTTKLQEDCQGNKKLLYKLVNDKRYERTNIVVLETEEGKLLRTESEIRSEMRNHFNSLLNGNVDSSDDSDCPAEETPEVLQPLTWLEVESALRNMRNGKSPGFDELSSDMMKAAGTPGLQWIYRVLSVIWTNNKIPDDWTKGIIIPLFKKGDRKKCGNYRGITLLSHTLKLLEKIIETRLRKIVEPLLEEEQHGFRKGRSTIDLIFAVRILAEKYWEHGKNLVMVFLDLEKAYDSVPRNKIWKCLEDLKVPNYLIDRVKMLYQTCNSSVQIGNGRSEWFETKRGVQQGSALSPLLFIIVMDRMLKSIKETANESRSLVFADDVVIWGETEKEVQKSLTVWNNKFKEFNLKISKTKTVEMTINREGTSSNIYLEGTKIKSVSHFQYLGSIFSKDNTIRQEILNRTQKASNFYMQVRNLLWDKKVPQAAKLTLYNTYFTPILIYGMETCTLLKKDYSRIQATEMRFIRTMNQSTRRDKIRNEVHRETAGIRVPIANILGKRRLQWYGHVMRMDSTRTAKKYFRMEVGGRRPRGRPRRRWIEAVKSDIEKNGFNWDDVQDQMLYQDRMRWRALVSHTRETGDGK

SEQ ID NO: 3028 - protein, 512 aa, synthetic construct
  source 1..512: note = Description of Artificial Sequence: Synthetic polypeptide
  VARIANT 393: note = Any amino acid
MGIPLRPIVSTIGAPTYQLAKHLTSVLSPQVGKCEHHIKNSAQFVERIRQLRLSNSDLMVSFDVVSLFTRVPLKESLELIEKKFGPSFTKVFNFVLTSTYFLFDGEYYEQTDGVPMGSPLSPVIANMYMEEFEDKALNTAPLKPTIFYRYVDDTFVIWPHGEDELQVFLQHLNSIHSQIQFTMEVEQNGQLPFLDVLVRRKPDGTLGHSVYRKETHTDQYLHASSCHHPSQREGVLTTLVHRARVISDEESLKPELDHLKEVFQENGYSDRQIRRAFKHKSTPQPTPEEDPPAKIAYIPYAGNVSGKIGRILRRQNIKCVYRPPAKIKSLLGTVKDDLGLRKSGVYHIPCECGKAYIGQTIRTIEERCTEHKRHTELQQPTKSAIAEHCLETXHKMKYEDTEVLHNTSRYWDCLYKEAIEIRLRENLINKDSGFQLSHAWNPALKFLRSRRKQNTEHSEGRAQTEVRHSSPEQELPPPPQHPGVRTRGQWRGVTAGIYSTAAGPAPQSAGVT

SEQ ID NO: 3029 - protein, 628 aa, synthetic construct
  source 1..628: note = Description of Artificial Sequence: Synthetic polypeptide
MSGTKSAEEKTCRRIRNKLKNEGALITKADKGTPWSGCPHHKGRQGNTMVIMKQDDYRNKTLTFIEDNNIHKLTSDPTQRFHKNTQTLLKSITHIFPKQKIKWLKQKNPKAPTLNCLPKIHKEHIPVRPVVNFRNAPTYYLAREIHSYLQKHYVFTNNRSILNTSELIQKIKHIIIPSTATLTSFDITSMYTNIPITETINIIKQQLQQQTDTPKSHIKETTNILKLITEQNYFTFDNQFYSQEDGLPMGSPVSGLLANIFLNHIENKIFDTIVKPKQYKIIYWHRYVDDIICLLDETPSRIQELHNDINNVHPKIKFTIETENDRRLNFLDLSIHRDKNQHKFSIYRKPTTTSTAIHKHSNNPITQKQAGFQYMLHRLNKTPLSDEQYKNELQTIKQIATENGYDTNIIDKLNHKIKAKLKGTTNTQKQTDQKHNTSTQNINPLNSHTPNTHTQEQKSNKTTNKWHTLTYDNKATHRIGNILKKQGLKVAYRTDNSIQRKLKTTNTNTDKHNTSGIYQLTCQDCNSVYIGQTCRNFNTRYTEHRRALKSNSHSTFAEHLINMNHKPTDINTDLKILKHSKSLPQKLTIEENYHIQKAIIERKEIINEYTALCNGTIFSALKELTENP

SEQ ID NO: 3030 - protein, 984 aa, synthetic construct
  source 1..984: note = Description of Artificial Sequence: Synthetic polypeptide
  VARIANT 97: note = Any amino acid
  VARIANT 174: note = Any amino acid
  VARIANT 220: note = Any amino acid
  VARIANT 305: note = Any amino acid
  VARIANT 403: note = Any amino acid
MMASSLKGSTTPGGNQSTIVKDNVSEPTDSGELTPTCKRLKSKKVSYFATFNVNSLLKIGKLKHLTDTLTNQNIAITALQETRYTDEAAFESEGFRXLKGKPGKRVMKNVPQLGTGFIINRQILGAITDFSSKSSRLSTLTFRGANKMYTMVNVHAPTNETNKTDPEKVEEFWXDLEETLSKIPTKNVIILLGDFNAQLGKERKYRNIIGNYPAHNRTNXNGERLVEICKTFDLIMKSTAFKRLPRKQMTWVCQILCKTDDMGMPNPLLGEFQLDHVAIPKRAGKEIQNVKVLRGANLDSDHFLXKIKIKIIPKVHQPRNTIRTVKYDTGKLKTSTDFKTSLSQKDYQGWEQLKDAAIEKRRKAWADWCSHKTLENLNKFQEVRKNTAKTIRNLKRKYEQARXTQIEEDFQKNNTRDFYRTFKTNLNRYDPPTLSFKNKEGKIVYGEMENSQILAEYFEELLNCEAPADTFSYNDTEPNPDSEPPTTEEIKNIINTLKNNKAPGEDGIIAELFKYANENVIIELKQIISKIWEEEKLPEGWTSALVHPIHKKRRYIPFTKKGDKTDPGNYRGISLIPVAYKVFSKALLNRVEKQLNPQIDEYQGGFRKGRSCAEQILNLKMIMAYQKQRCKKFVLTFVDFKKAYDSVDRQTLFQILKEMKLDRKSSELVRQTLNNTTSKVKFRGKLSESFKINTGVRQGDGLSPMLFNCVLDKVIREWRQGMKGVGGIRLGCKKKGIRVDCLAFADDIVLLSESLEEAVNQTKELQRQAAKTGLQISIEKTKYMTNITEAPGWMAIDRGKIQKVEKFKYLGEWIDTGLTEKDAMEARINKINLAYKLTMNIYNKKNISINAKLKHYQTVIRPEALYAAETLNLIRTGVIKRLELVERKILRRILGPRRTEDGQFRNRSNQELYSKIEKISNIIKKRRCEFFGHICRMDQGRLTQQISQFLLYKKSKIRWIQEVQRDLEEMGIRDQEIHNRVIFK

SEQ ID NO: 3031 - protein, 1084 aa, synthetic construct
  source 1..1084: note = Description of Artificial Sequence: Synthetic polypeptide
  VARIANT 852: note = Any amino acid
MSQSPVASSVAVVGNKAAVTVPLREDSPVASSVAAVGNKAAVPVTVPPQZASTATASTAPPNEEAAEKKKRSSREEEVVSSVAGRRKMVPPLRLKDFLVEGSKMKNLEISDLKHPIAPHQNVHSKGNSSSELKFATNLLPEHQGIKDKEFFVNDFGLDNNFDIFCFSEHWATENELTLVLDTYNIANSYCRKLHLRGGVAIYTNQSLSYSFTKLDLDYLCEEQNFEAAGIFIVSLKLVIISLYRSPKGIISVFLEKLEMLLNVFRESKWLHYDIVIGGDLNADFDVTTNKGVSLNCNDKQRSVTELKNLLRQHNLHSINSRPTRDKACLDNIFVNFKTAEDSCMNCRRLMYVTVFPFSDHDAVSVNYISRFHPDKCDIPVPKVVITRPITDDKISRFRMALADREWFDQCYGDTHCSLSSDLSAKVVFDRFFKTFLTLFNDSIPLKNAKQHSPKKCKVIDKGFKTKVTNRQNPWYTEQLTNLKHQLMVLYNISNALKTEHARSAYVKCRNEYKKAIVEAKKAHNFRSIENSTNKCQAAWKLINSVAKDPRNKSVNVSPQKFNDYFIKSVEEVGNAIIKPDIRSSELLSKNVSRSTTNINVFTFSEVSPSLILKIVKQLKSSDSADIYDISCNMLKRVIDCIVYPLTFCINKCISEGYFPDELKVSRVVPVYKKGDTESPSSYRPISIVPAFSKVLECVIYQQLSVYFENLGLISESQYGFRKNLSTVDAIDSVVKYLHQVFEDKGFAQVTFCDLSKAFDCVEHTPLLDKLEFYGIRDISLKLLKSYLQNRRQVVCIGKEMSSTEQVKVGVPQGSVLGPFLFLIMINDLPSFIKSSTVLYADDTTFLHSSNDXSSLKTCVAKTLDQASYWFKANGFLLNETKTQQMVFTLKDKLPSDDPSYVKFLGVYLDDKLSWGQHVKYISGKLSRVIYLLRRLMDYVPEKYVRITYFSFFQSIITYGIILWGNSSCVQDILILQKKAIRVITGSPHKEHCKPLFCKLKVMTVINLYIYYVLIYTKRKLPETKLRENVHYYNTRRNKCIFTSYHRLSKSLNSYELVGINYLISCHNMYKIYPNKHLNKRCMTG

SEQ ID NO: 3032 - protein, 752 aa, synthetic construct
  source 1..752: note = Description of Artificial Sequence: Synthetic polypeptide
MQAIAEDKRSRWCNLVENLEEITVVQSCREPRMKQNSMEIIKKLEWDPTDHKQKNNGVTANQIASQLLKNGKTGGKKKGKELYPKNKKMMASSIHIHSNRTGRRHSEYETEWPPQYTFTATELEDAIQSMKLNKAAGTDDLRTEQIKHFGPKVRNWLLQMINACIKIPKLWRQARVVALLKPGKEIRILKVTDQCHFYAISTRCWSGDPKTMAAGEGGGLTKTWQGDTDPKSYRPVSLLCHLYKMLERMILNRVAQIIDGKIIKEQAGFRPGRSCCGQILNLTQHIEDGFERKLITGAAFIDLTAAYDTVNHRKLLCKLYHLTGDCRLTMVIGSLLQNRRFYVSLNGKNSRWRLQKNGLPQGSVLSPILYNVYTNDQPIPQDTRLFVYADDTAVAVQGSSFDEVSQKHPVVLKNLLNTTMPITSIPKTSSGLEELAQYYDANHLKPNPCKTQVCAFHLRNRDAGVDLDVTWQGKKLDTVQHLNTLGYTIPWGTLDRTLSFKQHCRNTKAKVCSRNNIIRRLTNYEWGAQPSVLRTSALALCVSAAEYAAPVWDASAHTKQVDVSVNETMRIVTGCLRPTPTGNMYLLAGIAPPRIRRQVAADAERTKKENDYRHPLNGHVTQARRLKSRNSFIARTKILDGSQEDNRVCKWKNEQTGLPITPKEEMAPGNKLPYTVWRTLNRMRAGVPRCKTNLRRWGLLTNDDDALCECGEVQDEAHLLTCRLLPEPCSFSDLLQANDKAVAVANYWKNKT

SEQ ID NO: 3033 - protein, 1900 aa, synthetic construct
  source 1..1900: note = Description of Artificial Sequence: Synthetic polypeptide
  VARIANT 14: note = Any amino acid
  VARIANT 50: note = Any amino acid
  VARIANT 90: note = Any amino acid
  VARIANT 92: note = Any amino acid
  VARIANT 94: note = Any amino acid
  VARIANT 121: note = Any amino acid
  VARIANT 170: note = Any amino acid
  VARIANT 249: note = Any amino acid
  VARIANT 261: note = Any amino acid
  VARIANT 286: note = Any amino acid
  VARIANT 315: note = Any amino acid
  VARIANT 353: note = Any amino acid
  VARIANT 357: note = Ile or Leu
  VARIANT 386: note = Any amino acid
  VARIANT 399: note = Any amino acid
  VARIANT 403: note = Any amino acid
  VARIANT 427: note = Any amino acid
  VARIANT 458: note = Any amino acid
  VARIANT 481: note = Any amino acid
  VARIANT 526: note = Any amino acid
  VARIANT 556: note = Any amino acid
  VARIANT 1300: note = Any amino acid
MALPGAKPASLSVXGPNLMLRHMTPRRSLPWPRHGRNAGREIEVRLMPPXTWYVPGLTANRLPPRSPCFLWKTLRISSGRWMACQDEIWXCXHXDVVPSPVTGTACLVRGGGWHVKMRSGXVLITTSSPAQSRALLACDKLGDVPVSITPHKSLNMVQGIIFHKDLLLQXDDELRKNLERRGVHFIRRVHRGPKDNRVATGAFILAFEGDSLPEKVKVMIYRCDVKPYVPPPMRCFKCWRFGHMSSRCXGNPTCRECGRAXHPDAPCAPPPVCVNCGQHHSPCSPXCTVLHKERKIMEYKTLDRLSYSEAKRKYXKLHPVSMKTSMPQLHHTASAISATALHCLVFHSGPPGXTAHXCPHGLWGHLNLHRPQGPCFGSTTISTVGXSVPTPEPESQQPXLAPXARKGSLGSLPSKASPADASGWLKXPPTAGRRASRASSVPGDGSAEPSQHEKPKEXREKKKKKNKSKTKDSLVATVPPXHSTSSSEDEIEILASPKDLAIAESSEAMDVEALPQKSATAEDTVXPTAPSKSACPSDQEALGSASKIGDSRRYCXPYCAVEISMSQRPGGSLILQWNCGGFFRHLPELQQLLCRFPAFCVALQETWFPAQRTPALRGYRGYYKNRTIYDRVSGGVCIYVLATVPSAAVPLHTTLEAVAVRIRAMQELTICSLYLPPDEMVSLTDLAALVAQLPPPFLLLGDFNAHHPLWGGAQTTGRGRDIETLLSQQDICLLNTGAPTHFCVARGTYSAIDLSVCTPSLLPHLSWGGSTMTFAGVTISPFFCHSSTWTSGSHPMVSIAADWRGYTSAAVVSVPLPPDIDTAVQQVTAAIVSAAEETVPITTGSPRRKVVPWWTPEIAEAIRDRRRRCNATGAAPQSKIGHPGPSAALQRHRRRPTIENLIAFKRLRARARRLIRQSKQDCWERYVASIGSRASPSRVWSQVRRLFGYRPPAGIPSLTVDGTLCTDPAVIAECMAEHYASCSATANYSASFRSLKQRVERNPLSFHTRRRELYNARLRSGSLTLLSLHAPIPLRDQTAYTASSSVTCQRTFITNCSPYLIGSGQGVFSHPSGGIVLLSLSTTGGAKSSIFPHSPPGTVQCSFTEWEFNTALAACPDTSPGPDRIHGQFVRHLSADFHHKLLALFNRVWTGGVFPSQWRDSIIIPVMKPGADPLAVDSYRPISLTNVLCKLLERMVSRRLMWILEDRSLLAPQQGGFRQGRSTIDNLVSLESAIRTAFSRCEHLVAVFFDLRRAYDTTWRHHILATLYDWGLRGPLPIFIKNFLSLRTFRVRVGTSLSSXRVLENGVPQGSVLSVPLFLIAINGLAAAVGSSVCCSLFADDFCLYYSSPSIGVAERRLQGAIRRAQSWATAHGFTFSASKTRVMHFCRRRAVHPDPELYLAADQLHVAETHRFLGVLFDNRLTWGPHLRQLKQKCWRHLNILRCLSHTAWGADRRTLMHLFKALIQSRLDYGSQVYDSASPSALRILDPILHGGVRLATGAFRTSPVPSLLAEAGIPPLRYRRQQLLASYIAHVHATPHHPNRRLLFPNTDLPSPQRRPRSGLPVAVRVHSLLSSLESFPLRPAFSCLSHIPPWTIPRLQLHLQLSCDPKASVSPQLLRHQFLDILGTFRDADVIYTDGSQVDGRVGYAYVHGDHTEQRSLPPGCTVFTAELIAITRALDHLRACPRKSYLICSDSLSALHALDQCFPKHHLVRSIQVTVFSLGKSGRSVAFIWTPGHIGIPGNERADQLAKQAIACQRLDIGTPEGDIRLGLHRKIFEAWNSEWATMSTPNKLRAIKPSTAAWKTSLRPSRRDSVVLCRLRIGHTWLTHGHLLRREEPPECRCGALLTVVHILLDCPLLAALRQSFNLPTALPSILADDASMADCVLGFIRAAGFYHKI

SEQ ID NO: 3034 - protein, 757 aa, synthetic construct
  source 1..757: note = Description of Artificial Sequence: Synthetic polypeptide
MGLPFKLNAGGNALKLGETVVNLSSRKLSPLEERVLDRGLTFIPTSKTLSHEPILSSVEHVNRTFKLNFFFRNRLGRGKRIPFIEKSGWTPPDSAIDSDILATCDKLHEEISHLPLVNEKHNLTKFERKALNSLKNDQNIIIRKSDKGSCCVIQNREDYIFELEKQLNNANHYRVLDQPIFMETAQKINNILKTLVNKQFISDSQYDYLSAKPEVRQRHIYTLPKIHKNPETEWSLANRIPKGRPIISDCASESYRVSEYIDHFLLPLACKHPSYLKDTTDFVEKIKSLNVPPNARFISLDVTSMYTNIDNKTGLDAVRKAFLRNPCVDRPDKEILELLELCLTRNDFAFNEKIYLQTSGTAMGKRFAPSYANIFMAEWELEISSISPFEPFFYGRFLDDIFIIWTESLTNFWQYFEILNNHHPSVKLTANISEQSMDFLDTTVFKGPSFSQTNKLDIKVFFKPTDTHQLLYKNSFHPKHTFTGIIKSQILRFFRICTQKVDFDAACRLVFSKLRERGYSKRFLRKIKNDTVLDLLKINEPPPPINNFGAIPCRGSRCRTCEHIHMSHYFQNKKNGKIFEIKERLTCTDKNIIYLISCKKCDKQYVGETQNALRTRFSGHRFDIIHSKNRPISHHFNLPDHSIEDLLIMPIESIPDSDLIKPKTKRLQRESYWMDQLQTVAPNGLNIQHDNQMIPFVATFNHTAAKTSSIVKQYYSELQNRFPNVYTKRLVIAYKRNKNLSNFLVRGRLDPIESNNT

SEQ ID NO: 3035 - protein, 725 aa, synthetic construct
  source 1..725: note = Description of Artificial Sequence: Synthetic polypeptide
MFSCRFFLIRKSDRKICLDCKVIPGESLTTQHRVMVMDVRVKRRAKRRSQNGAPRIKWWHLKGEKLRIFQHKILEGGFRQPHGSANDMWERMAHEIKKVAKETLGESRGFGPRGKESWWWNDSVQSKVRIKRDCFKDWSRCKNVETWDKYKIARKEAKKAVSEARTQAFEGLYQSLGTKEGEKSIYKLAKGRERKTRDLDQVKCIKDEEGRVLVQERDIKGRWKKYFHNLFNEGYEILPDSNRLDIGEEDRNYNYYRRIQEHEVREALKRMSSGKAVGPDNIPIEVWKSLGDRGIVWLTNLFNEIMRTKKMSDEWRRSTLIPIYKNKGDIQNCANYRGIKLMSHTMKLWERVIERRLRKETRVTDNQFGFMPGRSTMEAIYLLRRVMERYRTDKKDLHLVFIDLEKAYDRVPREILWKALEKKGVRIAYIRAIKDMYEGASTSVRTQDGTTEDFPITIGLHQGSTLSPYLFTLVLDVLTEHIQELAPRCMLFADDVVLVGESREEVNGRLETWRQALEAYGFRLSRSKTEYMECNFSGRRSRSTLEVKVGDHIIPQVTRFKYLGSFVQNDGEIEADVSHRIQAGWLKWRRASGVLCDKKVPLKLKGKFYRTAVRPALLYGTECWAVKSQHENQVSVAEMRMLRWMSGKTRHDRIRNDTIRERVGVAPIVEKLVENRLRWFGHVERRPVDAVVRRVDQMEESQVKRGRGRPRKTIRETIRKGFRGQ

SEQ ID NO: 3036 - protein, 1088 aa, synthetic construct
  source 1..1088: note = Description of Artificial Sequence: Synthetic polypeptide
  VARIANT 232: note = Any amino acid
  VARIANT 487: note = Any amino acid
  VARIANT 621: note = Any amino acid
  VARIANT 707: note = Any amino acid
MGIFCCGRLKTKRQRHTPASKGVSRLTLACWNIRTMLDTANSGRPERRSALIAHELSRLNIDIAALSEVRLHEEGSLKEHGAGYTLYWSGKSKTESHLSGVGFMIKNSIVSKLENLPIGHSDRIISLRLPLHNKQHVVLFSIYAPTLQADPAEKDKFYSDLRRLTQKVPIDDKIIILGDFNAQVGKNFEAWKGVLGKHGVGSCNDNGRLLLEFCAEQQLTITNTIFQQKDSXKTTWMHPRSKHWHLIDYVLVRQRNVRDVCHTRVMPSAECQTDHRLVRCKLNFHFKPKPKRGGIPRRRLNVNNLQIAAVRDSFQANLQTRLEDHLIDSSPEALWQHIKNSILQSSVESFGFSLKKNKDWFDDNNQEVQELLTKKRSAHQAHLAQPLCHVRKAAFRLACSKLQQKLRDIQNKWWLNLAEKTQLCADLGDHRGFYEALKAVYGPTYQVQSPLLSADGQTLLTDKISILNHWSEHFQTLFSANRVVQGXGIQHILQHLVKNELDIAPTMGETLKAIQQVKTGKAAGVDGIPPEIWKHGGQALHAKFHELVVRCWEQGKLPSDFRDAIIITLYKKKGVKSDCSSYRGITLLSIAGKILARILLNRLVPAIAEELLPESQCGFRXNRSTTDMVFVLRQLQEKCREQNKGLYVTFVDLTKAFDTVSRKGLWLILERLGCPPKFLKMIILLHEDQQGQVRYGDALSEPFPITXGVKQGCVLAPTLFTIFFSMMLQRAMVDLDEQNGIYIRYRTDGSLFNLRRLKAHTKTLNHLVRELLFADDAALVAHTEAALQRLTSCFAEAAELFGLEVSLKKTVVLYQPAPQEDYHHPHITIGESELKSVQQFSYLGSIISSDATIDKEIDNRIAKAYRAFGKLHKRVWCNKHLKKSTKISVYRAIVLSTLLYGSESWVIYRHHLRLLERFHQRCLRTILNIHWTDYVSNVTVLEQAGVTSIEAILLKLQLRWAGHVSRMKDHRLPKIVFYGELATGCRKRSAPKKRYKDSLKQYLSLGHIDYHQWSTLASNQETWRHTIHNAVVSFENTRRISLEEKRQRRKNRAPPIPPKETFRCAFCNRICLSHIGLFSHQRACSKRG

SEQ ID NO: 3037 - protein, 997 aa, synthetic construct
  source 1..997: note = Description of Artificial Sequence: Synthetic polypeptide
MNSSTNLRPSVPGGWNVPADGSKQVYRKAEGAKNHRVSCHGFYLATYNCRTLSTEGKLLEIEEELKHVKWDILGLSEVRRKGEELLELKSGNLLYYRGTNDGRCSGSGFLINKRIKDNIIEFNSSSDRVSRLVLKISKRYEFQIIQVYAPTTSHTDEEVEEFYEEIEKIRGRKQQFTVIMGDFNARVGIQLQGESAVGKFGEGIRNERGQRLVEFAESENLFIMNSFFKKNPKRKWTWRNPSGGTAEIDYILASKKYLIEDCTVLNKFNTGSDHRMVRCKVHINVKNERKKMFKGPRSGIDIGKLKANQNLFQIELKNRFAELKANQNLFQIELKNRFTELTNLTEDIDIKNLNTNITNILIQTATEVAGKQRQVKNDKLSDKTKLLLNKRREMKINGNAVSKKIEYAELCKTVRKCITDDIRKYNCNLVKKSIEENKGIKSVKKHLCCGRKRIFALKAKDGKIIKNQEDILKRVEEFYSDLYRDTNNSCLVQNSKSEIPPILKEEVHLAIKKMKKGKAPGEDGITVDILHEGGEQIEDILTDLFNRCLKQKDVPEDWKNATVILLHKKGEREDISNYRPISLLSVLYKVFTRILADRLKRSLDEAQPREQAGFRAGYSTMDHIFVLREIVERTNEYEIPLCLAFIDYEKAFDSVMTSAVLNALANTDTDSGYVDIFSKIYSQASARIRLHKYSEKIKIGKGVRQGDTISPKLFSAVLEEVIKKMDWDKTGLKIDGEYLSHLRFADDVVLLASNPNELQNMIQSLATESKKVGLRINISKTKVMYNNFADQQKIKLDNIVLEEVSGYIYLGQLLTLDGDLMPEINRRIKLAWSAFGRNNSILKGKMPLCLKRKIFDQCILPVLTYGSETWTLTKRAIQRLQTTQRSMERCMLGITRRDRKRNTWVRSQTKVIDVIQKIKKQKWTWAGHIIRINDNRWTTKVLHWIPRDKKRPRKRPHYRWRDEIVNFTSKCWIREAVDRKNWKLLGETFILQWIDNG

SEQ ID NO: 3038 - protein, 994 aa, synthetic construct
  source 1..994: note = Description of Artificial Sequence: Synthetic polypeptide
MMSGTHDSDNARAFPGVGDAQSLRRPRAVRSRLGLSHQERVRLKKLARRPLLVRIASLNVGTMTGRGREIVDMMERRKIDVMCVQETRWKGDKTRELGEGYKIFYSSASKEGRNGVGIITSRKMKENIIEVSRRNDRIMRMKLDIGETIHVVSAYAPQVGTSMEMKDTFWKTMDEELRQLEEKDRVIIGGDLNGHIGTNKRGIERIHGGHGFGDRNQEGEQIIDFAVAFDFALANSFFNKKEEHLVTFKSGGNSTQIDYFLYRRKHLKEVKNCKVIPSDHVATQHRPMLMDLHLLRPAGREKVKTRVKVRKTKWFKLKDTVLRSRFKETALQRVSMDFEDVQEWWNRNAEVIRCTGREILGETTGKCWENKESWWWNQEVQAAVQEKRKAKKKWDSTHAPADLEVFKVRNKQAKKKVAQAKAKACQELYDDLETPEGQKKIYSIAKHRSQTAKDITHIKQIKNVNGEILRNTGKIQDRWKEYFEELLNVENERKYHEDGIPNEGLTRDITKSEVKVALKQMKNGKAVGLDGIPAEAWKALGEEGLDLLWDLLGKIYREEEIPDEWRESIIVPIYKGKGDIQMCGNYRGIKLMSHTMKILERILDKRLRAEVKIGGQQFGFMPGKSTIDAIFCLRQMMEKFREKQQELHLVFIDMEKAYDRVPRQEVWRSLRLRNAPEKYVRLIQEMYRKTTTKVRTCLGETSSFEVGVGLHQGSALSPYLFNTVIDVLSEKVREEAPWNMLYADDVVLCARSRAEVEEKLENWRKALEDRGLKISRSKTEYLACNIGTQENEELKLMETTVRKTDHFRYLGSIVDELSETGREVNNRIQAGWKNWKEVSGVLCDKKIPVRLKGKVYRTVVRPAMLYGTEALPLKKSNLQRMKVAEMRMLRWMCGVTRADRIRNEHIQGTVKVTDIASKIQESRLRWFGHLMRRDEDYTGKRLMNIKVEGRRKRGRPKRRWQDIVDDDLRSKGLRREWTKDRTQWRKLIKNSDPI

SEQ ID NO: 3039 - protein, 934 aa, synthetic construct
  source 1..934: note = Description of Artificial Sequence: Synthetic polypeptide
  VARIANT 879: note = Ile or Leu
  VARIANT 887: note = Any amino acid
MKNFTFDVLGVSEVRWTGKGELSTGDFIWSGEEKHHFKGVGFLLSKKAQKCLISYNPISSRIISARFSATPFNISIIHVYAPTTDASDEDIESFYGEIKNTLRETPKKDFTIITGDWNAKIGSNNTGWESAMGKEGYGDRNERGERLLEFATEHNFYICNSRFRQKPCRKWTWTSPDGIHHNMIDLILVQSKWKTSVQNCRTFQSADIQLDHSLVLCNIKIRLKKQSTTSQGTLDFRKRNSNDLKQPPIKQAYEKSLNEQLKKITPTMSLDEHASILESAIKTAIKSSLAVTEKPRKPWITENTLKVANEKRKWKLKRHISEENNNIYKAHCIQVKKLAKEDKENWLNEQCEAAENGLKTGKTHQAYKLIKMLRKPFTPKLNILKDDAGKILQTKTAITNQWTKYCSTLYNGSNNNQSQATDAELEEITPPADEYPCPHILHSEVEAAIRTLKQRKSPGFDEITAEMIKAGGPKLTASLHELCQKIWLEEKIPTNWGKTILIPIPKKGDLARCENYRTISLISHLEKVFLIILLRRLQHQLEPYLAEEQAGFRKDRSTVQQILLVRLLAEKAKRKGKKIYNCFIDFQKAFDSINQQRIWAVLASFGVDRKVVKLLQNIYENTRLAVKTGNDMGTWFKMLIGSRQGDPLSPLLFITYLERTMDSVTKLNLGVTIQGSIISNLRFADDINLMNEDLQALQDQATALQASAEKSKLRINTSKTKTMVFGARNIEQQIEINNQPVENTEQFEYLGSIITWDNNCSVEIKNRIAKATGALASLKHIWKSSKITVPTKLRILSVCVFSVLLYAAETWTLKENDKKKLLAFEMRCYRRLLKIKWQDKIRNEEIRNTLNIHTTIIDLIRQRKLRLFGHICRMDNNRXIKHVVTSXMNGKNKQGRPPRAWMDDITDWCKCSAQEAFHRAQNRNQWKTATRTND

SEQ ID NO: 3040 - protein, 628 aa, synthetic construct
  source 1..628: note = Description of Artificial Sequence: Synthetic polypeptide
  VARIANT 6: note = Any amino acid
  VARIANT 38: note = Any amino acid
  VARIANT 45: note = Any amino acid
  VARIANT 48: note = Any amino acid
  VARIANT 77: note = Any amino acid
  VARIANT 291: note = Any amino acid
  VARIANT 613: note = Any amino acid
MRLTVXLANSNCTIKDVSVLNQFNTGSDHRLVHAKVKXDIQCERXRLXQHGGQKVKKEEYSLKLQTDSKCSQKTKVXYGIHTMRQCRRNRGNSTKKSRQENIHQNTGADRKEKEDEDQIHYQPDRIEDEVRKSPRRRQFNIKLLKEGGVPLYKQLAGIFSDCMRTGQIPDSWKNAVIVPIHKKGDKTDLRNYRPISLLSTIYKVFTIILTRRLEQVLDSNQPREQAGFRKGYSTMDHIHTINQLKEKCKEYHISFCMAFIDYEKAFDSVSTEAILTALSNQGIETTSTQNXCCKDSGIAPRPPSVRRNLLRIIYEEATAIIRLHKDSRKIKIQRGVRQGDSISPKLFTACLEEIFRQINGWEHKGININGEYLNHLRFADDIVLFAQTPNELQEMLSDLKTESEKIGLQINYEKTKVMFNAEVIPQPVTIEGRTIERVEEYKYLGQVITTQGDQMREIQHRTQLGWHACGRYSNFLRDNRIPICLKRKLFNMCILPVMTYGCETWTLTKKMEQKLATTQRSMERYMLGFTRRDRKTNIWIREQTKVEDILVTVRSSKWHWAGHIARYTDNRRTKRITEWQPRQGKRYPGRQYKRWRDDIRKVIGSQWMQIAQXRYIWKQKEAYISSSG

SEQ ID NO: 3041 - protein, 975 aa, synthetic construct
  source 1..975: note = Description of Artificial Sequence: Synthetic polypeptide
MIRSSQAENDARGANPPGGPIADVATGKKDHLSCKDLFTIGTWNVRGLNIGKLEIIKREMTRTGLDLLGISELHWTGSGDLKSDDYTVHFSGNDHNRRRGVAFVANKRLAKYIENARCISDRIMTIRLRGKPLGVTIIQVYAPTADADKQDIVDFYTAIQNALDQTPKKDIIYIMGDFNAKVGDGEDGQVVGRHGLGDRNDAGDRLVQFCQENKLRITNTFFKQHKRRLYTWTSPNGQHRNQIDYILCQQRWRGSITAAKTLPGADCGSDHQLLIARIKIRLCKVKKTVVAKKFDVSRIPTQYTIEVRNRFEALSLDGGQTEELWAMIKGTIIETALEYVPYKMPTKGAVWLTEKTLQIAEKRREAKAKGEIDKARRLHADFQREARIDKNNALNARCISLEEAFRKGRTRELFATVKQVKTPFSARQSTIKDRDGNELTDQQDIKERWREYTEDLYTSIDDQQNEDQTDQGLQEPDLLESEVEWAMRQLPSNKAPGIDGIPAELLRPIPRAALTALCQQIWKSCTWPADWRRSVFVPIPKKGDTRDCANYRTIALIPHASKILLKVIQKRLGNVIDRELPDVQAGFRRGRGTRDHIANLRWIMEKAREYQKKLYMCFIDYTKAFDCVEHSKLWVALRELGVPEHLIRLIRSLYQNQEATVRTRYGDTDWFKIKKGTRQGCTLSPFLFNLYAEVIMRKLDLEESEVGVKIGGRTISNLRFADDTTLLAESEKDLKRMIMKLKNESEKMGLQLNIKKTKIMTTAAKEVHIKINNEEIEVVDSFIFLGSKVDCNGDWRPEITRRIALGRTAMVNMDPIWRCKDVSITTKRRLVTAIVFPIATYGCETWILTKADRRKIDAFELWCWRRLLRIPWTARVTNKSVLERINPDFSLEGKITRQKLTFFGHVMRANSLEKDVMLGRMSGTRPRGRPKTRWLDTIKKDTGKNIEELRELVRDRKTWRDMTHRIAKNRTRLNG

SEQ ID NO: 3042 - protein, 649 aa, synthetic construct
  source 1..649: note = Description of Artificial Sequence: Synthetic polypeptide
  VARIANT 95: note = Any amino acid
  VARIANT 280: note = Any amino acid
YDLALIQEPWHYKGQIRGLNCKEGKLFTFTSDSGPRTCVFVRNNINVSPVWDFCSRDITTVRVKLDEGGVSRELIVSSAYFPYDKDELPPTPEFXLLVEFCQKNHFDLLVGVDANSHHVVWGSKDINRRGEYLLEFLMGTNLFVLNKGNEPTFVVVNRREVIDLTLGTQNISDLIENWHVSGEPSSSDHRYICFNLQGMVPSQVTYRDPRRTNWASFREDLKFNLGGIQSRFCSVVDLEMTVDQIQQAILLSYHQNCPVRTARSSRQVPWWNEQLGGLRXNVRRLFNKAKRTGDWDTYRSALTCYNKAIRKAKRSSWKRYCQGIEDIPDVSRLVKIMSSGNFCKVGSIRLPDGSMTSTCKDSLKELFRVHFPGSTLIEGSSCLQVQSDLDGHVYHAKREDWGLVRGVINQSNIRWAVSVFKPFKSAGPDGILPVFLQQGIDILASPLCRVFRACLAFGYIPWSWRQVRVSFIPKPGHSSYTEAKSYRPISLTSFLLKTMERLVDRFVRDGALLKTPLCRSQFAYQSGKSTENALHEVVSLIERAIGYKEIALGAFLDIQGAFDSTSFEQISLAASRHGVCSTIIRWIGSMLKHRVVYSTLYDEEVKILTDRGCPQGGVLSPLLWCLVVNELLTLHSMGKVSSLLGMLMT

SEQ ID NO: 3043 - protein, 480 aa, synthetic construct
  source 1..480: note = Description of Artificial Sequence: Synthetic polypeptide
  VARIANT 314: note = Any amino acid
  VARIANT 317: note = Any amino acid
  VARIANT 480: note = Any amino acid
MRAAFDKVNRREMWEMMEKLGLGVRIRNRVKELYRGTRSEIRIGEDKIGGFELHKGVRQGCPLSPTLFNVAMADTEKELSKVQEGGIVLGKKKFWSISYADDVVMVANNATGLKQMLKKFKKIIERKGLELNTEKSKIMVFKNGGRRKKEDSFFWEKKEIEVVKNFEYLGYMLKENGKEEAQIKKLKEKASTVMSSMWGLGEELFRDNWELRMRLFDTMVKSVMEYGAEVWGWKGKEELEKIQRKYMKWVMKLDRTTPEHVLHLETKRYKLETRTRRRAIKYEVKLSKAKEGTLWRECWRTLEKEEEKERRRGXRRXNREEELNKRGWALSEYHRRLRAGEQVWSELERIEKDIQWQKWESEMRDSRQARDVKELIKPQGETPEYLRRTGNTGKKGLAMTARFRMGNEARGYKYWMKEEERICRLCREEEETFEYIFSRCNRTGSRENNWKNILNGERKNLAKLYRVIWVRKEKEKEEEX

SEQ ID NO: 3044 - protein, 1207 aa, synthetic construct
  source 1..1207: note = Description of Artificial Sequence: Synthetic polypeptide
  VARIANT 282: note = Any amino acid
  VARIANT 511: note = Any amino acid
  VARIANT 512: note = Any amino acid
  VARIANT 513: note = Any amino acid
  VARIANT 514: note = Any amino acid
  VARIANT 1098: note = Any amino acid
MEALKTQNIVSERISKIEQRLGPLEKRLKALDELPALKTRIHNAESTITELQAQIQDLSSRSPTMQQDNGSTVPNTAEICSLRSELAEVKRRQEQTSNCVVVVTGLHYTRETSLHLLAFSVVNALDPTVLRRDVASVRTMGRLDATNSSARGDGRLPPLAVTLSSSALARSIVIAKARKRKLHTSELDATLLEEAKALSPDHQGLININELLPSDVHKLRTRARLEAKKRQGCRTFVREGRLYTCAATMTASVLRSSTPTPSWRLFPGFRPLPTSSNTEATXQYTHQTLSSSAQERSKVKSEYLFCEVSAKGVSPIFVGVVYRPPHAPFFQGSNFIDQLTTHMHNYSTKVIMGDFNSDQLSSSEDAKFIKAFIDENSLSSVPYGATHHKQGSDTWLDLCLIDEQDRLLSYWKTNSPFINGHDLITATLDVQIPRYVPNTYSYRNFKGISAEKLRDFLSACDWSSLTSSSLDECISTLNANLTNAINHLAPLRTVTPRRQRHPWFTTVSHVXXXXRILVALRDLVSERDRLYRRFRDSRLDSDLRIYRLARDNAHKQVEEARLNYYYSRLSTLTDVAEIWRELEKLGISATKAPSPSRFTTDELNKHFSSISNDPLAPAVEDYLLTLESLDLPEHFEFSTITESDVLAAVSHFDTQARGSDGIPQVVISKALPVLAPLLSHIFNLSLSEPCFPSAWKLSLVRALNKVSSPTALTDYRPISLLCFLSKALEWLVHRQVSEYLESRLLLDNFQTGFRTGHSTHVRVGINKKKVTLLLLFDFSKAFDTVCHVRLLRKLSTFGFSKQVIRWFASYLTGREQAVVGDNSERFSPRRPAGSVWSLLLHCTSTTSVSALIPMFPILSMRMTCKFTVNATLRSSILYQTRRAFLSSASRRVRLVLAVALYINDIGFCLDSDVSHLIYADDLQIYSQCHLEELDSLSNKMSANAERIMGWAAQNRLKLNVNKTKAIVLGSPYYINALPKVTLINMGVPGQLHLLIWGCQVSFESSVRNLGLVLDSKLTWKEHVTQVCKRAHSLMYRLYFFRKSTNLRLRKHLVQALLFPIIDYCSLVYCDLTQELDLKLQRLVNTGIRYIYGVRRDEXISPYRRELQWLTTAGRRKYFTACFLRKMFNSVVPSYVLAFFDFRVTLRPVRGEVTPLEIPAFATETLRNSFHISASYLWNNLPSHIRNTSSTVTFRKLAKDHFFQLENT

SEQ ID NO: 3045 - protein, 1178 aa, synthetic construct
  source 1..1178: note = Description of Artificial Sequence: Synthetic polypeptide
MPNTRTLASRGEIRGLGGAGRIFRDPTCSVPRACILVKGFDALLLPARCSRDLTAIKIRLPVGEGSEREVVVASGYFPYDSQEEPPPREVQDLVEYCRQRSIPLILGCDANAHHIVWGSSDTNGRGDALLQYLVTTSLCIMNRGREPTFYNSVRSEVIDLTLCTVGMEGWVGSWRVSNEPSLSDHRYIQFEWKERCSETRAFRNPRKTDWAFFRENLRNELQSFKPSFGTTDELDHWAFELGEIVNISFQRSCPWTIPRGTWGTPWWNRELEDLRRETRRTLNRAKNTRNSIDWRIHREAQRLYKNRINAVRIKGWRDYCEDIERYPDAARLLRILAKNPEVWLEAIRLPTGEYATSEEECLKLLLEANFPGFRLSHEMGDESSGRNRQQRAAWDLAAKVVTPEKVKWAIRNFQPFKAPGIDGIYPAFLQEGLEELVGPLVKLFRASVALAHVPEIWKTAKVVFIPKTGKPSHTTVKDYRPISLNSFVFKTLERLVDRFIQDDILTVFPLHPNQHAYRAGFSTETALHSAVWRIEEQLERGEVMVGVFLDIEGAFNCTSIEAVVKEAGLHGMPGPLIKWLQGMLTRRTVISSLGTVTVSGEVSKGCAQGGVVSPTIWCLVANGPLEALNGWGCYAQAYADDFLILIKGSEIGAAMDAMQLALRKVERWCCSTGLSVNPDKVEMVIFSRKYKLDAYRAPKLSGVALQVKDSAKYLGIVLDKKSTWEKHLTAQCDKFLVALWTCRRAFGSTWGLSPRIILWLYRAVLVPRLAYAALVWWPRAELAGARAAPEKLRGQVLRGATGAYRTTPTKALGILVKVEPLHLTIIGMAAKAAHRLNAYGQWTQGTRHTRLPGGVGLLPEFSIKTDMMIPRYFFGRRYGVVIPTREEWKARRDSLPGTGDVWYTDGSRAETGTGSGYYCRRDGRGTFFSLGRYATVFQTEIYAILTCAQRNIELGARDRIITICSDSQAALRALMAHRTTSRLVWECKVVVNQLTAHNNKVRLLWVPGHTGIRGNEIADRLAALGAKHPPIGPEPYTGAARCLLAGEIRDWVEREHTKEWQGTQGCRQAKAVMGQDTNVGWTKCIAGGSRNNSRLLTQIVTGHIRLRYHGLKMGKEATGVCRWCEGAEETPTHVLTVCPKFAQLRHQCLGELFPTYEEIRALDAGAILTFWRRAGLPA

SEQ ID NO: 3046 - protein, 31 aa, Epsilonretrovirus sp.
HDFGHLWMHRGFVTSAGTPIKNHKEIEYLLK

SEQ ID NO: 3047 - protein, 1309 aa, synthetic construct
  source 1..1309: note = Description of Artificial Sequence: Synthetic polypeptide
GILPHSPVLPVRMNTPPARPRPRRRELNQQQRQQQQIHLPRARLERMCPKRINRHPHRLLAPEPNRLREHRLRLSRRPLRTSSRRWMTFGRSRMRPFRHKTPCLKGSLELRKGLALLQSRLKALDDLPALKTRLNNVESSISELQAQYQELSSRSPAEQQNISIAPASEEINNLRSELAEVKRRQERSANNVVVISDLAYTQETSLQLLAFTVLAALDSTVLRRDVATVRTMGRLDATTTNAQGDSRFPPLAVTLSSSALARSIIVAKARKRKLHTSELDAALLEEARALCPDHQGLININELLPPDIHKLRIKARLEAKRRRGCRSFVRDGRIYIRSGEDSERATIISTDAELEAFLAHTPPIANTDITHGFFSPYAANSQHGHHTLRHTPIIPPKPPSKSSNSSTSASKASLSEGLRVCHFNANSLTGHIEMVRLFLSTRSPFHVIAVTETWLSDKITSIPSLDDYILYRRDRNRNGGGVALYIHHSLTASVISSSDGEWSGKPGKPEYLFCEISAKGVSPIFVGVVYRPPHSPFIQGSNFIEQLTTHMHNYSTKVIMGDFNSDQLSSSEDANFIRAFIDENSLTSVPYGATHHRQDSDTWLDLCLIDEQDCLLSHWKTDTPFINGHDLITATLDVQIPRHVPATYSYRNYKGICAEKLRDFLSACDWSSFTTSSLDECITILNANLTNAINHLAPLKTVTPGRKRHPWFTAALRDLLTERNRLYRRFRKSRLPWDLYFYRIARDDAHKQVEEARLNYYYSRLSTLTDVAEIWRELENLGITTSKSPSPARFSSDALNKHFSSISNDPQAPSVEEYLRTLESLDLPEHFIFRAITESDVSAAVSHFNTQARGSDGIPQVVISKALPILAPLLCQIFNLSLSEARFPSAWKSSLVRALNKVNSPTALTDYRPISLLCFLSKALEWLVHKQISEYLETRLYLDNFQTGFRTGHSTQSGLIKLTDDVRLGIDRKKVTLLLLFDFSKAFDTVCHVRLLGKLSSFGFSKQVIRWLASYLSGREQAVIGDNNELSTSLPLNTGVPQGSVLGPLLFALYINDIGFCLDSDVSHLIYADDLQIYSCHLEELDSCSVRMSANAERIMGWAALNRLKLNVLKTKAIVLGSPYYINALPSIANTFINIGGARVDYESSVRNLGLVLDSKLTWKEHVTQICKRAHSLMYRLYFFRKSTNFRLRQHLVQALLFPIIDYCSLAYCDLTQELDTKLQRLVNTGIRYIYGVRRDEHISPYRRELQWLTTAGRRKYFMACFLRKIFNTSVPTYILAFFDFHVALRPVRGEVTPLDIPSFKTETL

SEQ ID NO: 3048 - protein, 1394 aa, synthetic construct
  source 1..1394: note = Description of Artificial Sequence: Synthetic polypeptide
  VARIANT 123: note = Any amino acid
MKIISWNVRGLGSSRKRSVIREVLRKEKPTIFLIQESKLTEVDRRWVRSVWSARGLSWAFTQSWGASGGIITIWKNEEMDCTEELIGNFTVTIKLRRKEDGFEWALTNVYGPNSYRERDDFWXELAAIRGLWNGPWCLGGDFNVIRFLNETTNPNHRVTSSMRKFNLFVDSYELRELPMLQANFTWSNFQEEPLCCKLDRFLFSSDFESAWRGLAVRALPRPTSDHCPVRLSQENLGGGPCPFRFENMWLLHPDFIKKVQLWWEEDQVEFRWKGYKFYKKLQALKARIKAWNKEEFGRVEERKEWIANRIQEIDGGEAERRLTVGEREERWKLKQELQEIIRKEEISWRQKSRCKWLKEGDGNTKFFHTLANGRKRKNFVGRLEWNGEVITSEEEIARAFVEHFKSIYDSPRREREEIPDLDWLPGNRVLMDQLEKNFEVQEVKDAIFSMERSKAPGPDGFTMAFYQDCWDIIGGDLMEVFLEFFERGKINSGANATFIALIPKKVNANHPKDFRPISLIGSMYKVISKVLAERIKKVLPSLISPNQGAFVSGRQIIDQILIANECVDYRKRQGEKGLICKLDLEKAYDLVDWGFLLEVLRIRGFGERWCMWVKGCISSCHYSILVNGVAKDFFPAKRGLRQGDPLSPFLFTLIVDVLSVQITRADARNLLRGWRVGREEIVVTHLQFADDLILFCEGDPEELENLKVLVENFEKVSNLRVNWNKSCVAGINRQEVEVASLARSLGCEVSDWPLKYLGLPLGGNPRSVSFWYPVLERFSKRLAGWKRNYISLGGRITLIKSTLANLPVYFLSTFKLPVKIANQVEKIMRDFLWEPGDTKKDHRVKWEVVSRKKDKGGLGIGNIRIRNAALLGKWLWRFPKEQESLWHKVIRSIHGMAANGWDAGLDPRASRFSPWKDIVGILPVFSPFIRYDACVGNKILFWEDLWIGESPLKDRFPNLYSLSLKKSQFISSFRASGDSWDLGLRRGLRDSEVDSANDIFSLLSSVFLDHSSPDSRIWAETSTGSFSCSSFFNALVLPSNPVSSFPVKEVWSAPVPPKVRAFCWEVVLQKINTLEVLQRKRPNWCLSPHVCSLCLRNGETVNHLLISCPFSALIWDWFSSLFDCRWTPPTSVADLFDPSFFRQPKKKGRVMWRTTRAAILWAVWEERNNRIFQGKEKSAPEVIEGITIKAVHWLKTLDLFKDVSIDDLIRGWSILARSSTSSPTIQAVWSPPLQCNVKLNFDGSSIGNPGPSGIGGVFRDAEGKILALYSGPIGLGDSLRAEVLALLQGLRWAKQLGFQQLEVEGDSKLVVGWLQSNSLGTWSLRQHVRELLSLTRELGAQVYWSRRSANALADNLAKQGVNREVFVLCSVVSYLLFRGHLLLWKVTVVSSGFI

SEQ ID NO: 3049 - protein, 1279 aa, synthetic construct
  source 1..1279: note = Description of Artificial Sequence: Synthetic polypeptide
  VARIANT 338: note = Any amino acid
  VARIANT 720: note = Any amino acid
  VARIANT 1233: note = Any amino acid
MDMCGCLQMSMGQMTTEREELWEELADVRGLWDGPWCVGGDFNVIRYPEETNKTNQRVTTSMRKFNRFVDAFELKEIPLAQKTFTWSNLQARPICSKLDRFLFSVDWEEHWGNLTSRALPRVTSDHWPIVLCKEERRSGGPAPFRFENMWLLHPGFTNRVREWWNECNPLVEWEGMRFHKKLQFLKAKIKEWNILEFGRLEERKRDLMDQLESLDSKEERGEFGEEDNELRRGLRRQLEDCLHKEEISWRQKSRCKWLQEGDRNTRYFHSLADGRRRRNFISKLVVDGIELTQQEEIAGACVEHFKSILRRPVSGRVWVEGLDWPDVGGDNRRSLERXFDLEEIKEAVFSMDRTKAPGPDGFTMAFYQDCWDILKEDLLMVFEEFHRRGIVNPGVNSTFIALIPKKKEASHPRDFRPISLVNSLYKIIAKVLSLRLKKVLPDIIEQNQGAFVSGRQITDQILIANESVESFKKDKKKGVVCKLDLEKAYDMVDWEFLRKVMTKMGFGARWCKWIMGCVRNCHYSVLVNGTVVDFFPATRGIRQGDPLSPFLFLLVADVLGKLIHRADSRGLIRGWRVGREDIPLTHLQFADDTILFCEGGNVSFIRNLKLVIQLFEQMSNLKVNFGKSCVVGVNLEEGEIRESAEVLGCEVSGWPLSYLGLPLGDNPKRESFWNPVVERFEKRLVSWKKNYLSLGGRTTLIKATLANLPIYFLSVFKIPXKVSSRLERLMRDFLWEPGEEKRDHRVSWKVVTRSKNYGGLGLGNIGKRNSALLGKWLWRFPLEQEKLWARIVASIHGMEQNGWDAGIRARTTSTSPWKAIHDLLPVFSPLVRYDLNSGNSIKFWEQIWVGNVPLKDQFPSLYALSDFKNEPISSFITPSSSSSGFGWNLGLRRAVRDSDLDSISSLLELLDNVFLDPSKVDSRIWTPTPTGSFSCASFFKVLCQSTSPATSPFPVNEVWCRPIPPRVGSFCWEAYLERFNTGDLLQKKRPNTCLSPHWCVLCKADGETGFHLLVSCQFAKSIWEWAFSLFGRRWNPPSDLQSLFSPSFFRWHMKRGRTMWRGLRAAVCWSLWEERNSRIFSEDERGAEELRAVIHIRAVQWLKSLELFTDYTVEDMLRKWGEIANCTQTKPVIRVSWTPPPAGFLKLNFDGSCRGNPGQSGIGGVFRDENGVISALFSGPIGVGDSLRAEILAVMEGVQKAKEMNVRKLIIEGDSEVVIGWLIKDNCGLWNYXNERRKFRWLVREMEIRMSWVKRSANSLADGLAKQGIEREAMFWAKL

SEQ ID NO: 3050 - protein, 1402 aa, synthetic construct
  source 1..1402: note = Description of Artificial Sequence: Synthetic polypeptide
  VARIANT 4: note = Any amino acid
  VARIANT 24: note = Any amino acid
  VARIANT 171: note = Any amino acid
  VARIANT 235: note = Any amino acid
  VARIANT 440: note = Any amino acid
  VARIANT 591: note = Any amino acid
  VARIANT 612: note = Any amino acid
  VARIANT 1018: note = Any amino acid
  VARIANT 1135: note = Any amino acid
  VARIANT 1170: note = Any amino acid
  VARIANT 1216: note = Any amino acid
  VARIANT 1254: note = Any amino acid
  VARIANT 1381: note = Any amino acid
MRIXSWNVRGLGSARKRATIKEVXKKFNPDVVLLQESKRMDFDCRRARSVWRAKGIKWAAAPSWGSSGGIVTLWKEDVLIGLEELIGDHSVSLKFRQVEDGFEWVLTNVYGPNDYRQRKKLWEELSDIRGLWEGPWCLGGDFNVVRLTEETNNPRQRVTTSMRSFNQFVDXFELKELPMLNNTFTWSNLQSSPICSKLDRFLFSTDWEAHWGNLTSRVLPRLTSDHWPIVMCKEXLRGDGPAPFRFENMWLTHPGFIEKIKEWWQHYNPPVQWEGMRFHKKLQFLKSQIKEWNRLEFGRVEERKQVLVEQIEELDMKEGRGLFGEEDRERRWSLRKQLEDLLIKEEISWRQKSRCKWLKEGDRNTGFFHSVANGRRRKNFISKLEVEGTVISHPVEIAEAFVGHFKSIFRRPLNERIWLEGLDWPTLSPENREWLERRFXLEEIKEAIFSMDRTKAPGPDGFTMAFYQDCWGIVEEDIGSVFEEFHRRGIINPGLNSTFIALVPKKKEASQPRDFRPISLVNSLYKIIAKVLSLRLKKVLPSIIAPNQGAFVMGRQITDQILIANESLESFRKSKKKGVVCKLDLEKAYDXVDWSFLLEVLKSFGFGDSWCXWIWGCIRSCHYSILVNGTVVDFFPASRGIRQGDPLSPFLFTLIADVLGRLIQRADSRNLIKGWRVGREEIPLTHLQFADDTILFCEGGDIEWIRNLKLAIQLFERVSNLKVNLDKSSLAGVNLEERELREYADVLGCATSDWPMAYLGLPLGDNPKKVSFWNPVVERFGKRLASWRKNYLSLGGRITLIRSTLANLPVYFLSVFKIPTKVSNTLEKLMRDFLWEPGEEKRDHRVSWEVVTRGKKLGGLGIGNLRKRNMALLGKWLWRFPLERDKLWTKIVASIHGLEDNGWEPGILARTTAASPWSAIHKLLPVFSPCIRYGLNSGNKIKFWEQLWVGDSPLMDQFPSLYALSDLKNEPISSFLSPSDSPSGFGWNLGLRRAIRDTDLDHILSLLAILENVFLDPXKEDTRFWVPSSSGVFSCASFFETLTQPSDPIGLSFPVKEIWSRPIPPRVGSFCWETFLERINTNDLLQKKRPNSCLLPNRCTLCKADGETGYHLMVTCSVAKSVWEWVFSLFGCVWXPPGSVQSLFSPSFFRWPKKRGKTMWRSIRAAVCWXLWEERNSRIFSDKERTIGNLLDLILLRVAHWLKTMELFSDYSVADXVRNWKEIASSALCKRTCSPSWSPPPSGFIKLNFDGSCXRNPGPSGIGGVFRNEAGAIIAMFSGPIGEGDSLRAEILAALEGIQRARELNIRCLVLEGDSEVVIRWLKGGGSGLWSYNNEKNKFKWLSRDIVVHYNWVKRTANSFADGLAKQGVNRDSTFWANFLXFLVFFGGELSLFTSPLYLSFT

SEQ ID NO: 3051 - protein, 1064 aa, synthetic construct
  source 1..1064: note = Description of Artificial Sequence: Synthetic polypeptide
  VARIANT 368: note = Any amino acid
MWKKEVLEGKEELIGQFSVSLKFRQVEDGFEWVLTNVYGPNDYRERRQLWEELADIRGLWEGPWCLGGDFNVIRFLEETNSTRQRSTMSMRKFNQFVDAYGLKEIPLSHSCFTWSNLQVNPICSKLDRFLFSNDWEEHWGSLNSRTLPRVTSDHWPIVICKEEVRNAGPTPFRFENMWLGHPGFIKKVKDWWLESNPTVKWSGMRFHKKLQHLKGRIKEWNLLEFGRLEERKQMVTAQIEALDSKEGRGCFTEEDKEQRWNLRKQLEDCLLQEEISWRQKSRCKWLKEGDRNTKFFHAMANGRRRRNYISSLEIEGATISNQSEIAGAFANHFRSIFRRPLNNRVWIEGLEWPTLKLEEREWLERKFXLEEIKEAVFSMDRSKAPGPDGFTMAFYQDCWEILKEDLRIVFDEFHSRGVINPGLNSTFIALVPKKRNANHPRDYRPISLVNSLYKIITKVLSIRIRKVLPTIIADNQGAFVKGRQITDQILIANESLEEFKRSKKKGVVCKLDLEKAYDMVDWSFLLEVMVNFGFGDRWCKWVMGCIRKCHYSILINGTVVDFFPALRGIRQGDPLSPFLFTMVAEVLGRLISRADSRDLIRGWRVGRESVPLTHLQFADDTILFCEGGDLNRIRNLKLTIQLFEQMSNLKVNFEKSCLVGVNMGEGETSECADILECAVSNWPLNYLGLPLGDNPQKDEFWIPVVERFEKRLATWKKNYLSLGGRITLIRSTLANLPVYFLSVFKIPAKVASRLEKQMRDFLWEPGEEKKDHRVRWEMVCRSKREGGLGIGNIRSRNLALLGKWLWRFSLEKDKLWVKIVGSIHGVADNGWDSGIVARTTRAAPWKAIQAILPLFSPWIRYDLHSGNLINFWEHIWIGDSPLKDQFPSLFTLSTLKNEPVSSFLVPSNSTSGFSWNLGFRREIRDTEFDCILSLLSILEGVFLEPTKTDSRIWSLTPSGSFTCASFFKALTQPPSLGLSFPVKEVWCLPIPPKVGSFCWEAFLERVNTCDLLQRKRPNSCLCPHWCALCKADGESEYHLLISCRFTKSIWEWCTSLFGCRWPPL

SEQ ID NO: 3052 - protein, 1015 aa, synthetic construct
  source 1..1015: note = Description of Artificial Sequence: Synthetic polypeptide
MTRRGQSHPDAPGLTKPLVHPKHAMRIGNWNVRTLYSSGNVAQAAREMGKRDIDIMGISETHWTGQGKMQLRDGETMVYSGREDNIHREGVGILMSKNAAACLIEWTPWNERMIQARFYSRHIQLTIIHIYAPTEDADEHLKDEFYTRLQEVLDSRNQHDMLIITGDMNAKVGDQNWDYERVMGKHGLGVRNDNGERLCELCDLNELVITGTLFPHRTIHKATWISPDGKTKNQIDHVLVNKRFRNSVKDTRVFRSADVGSDHYLVCATVKLRLRKDPKRKGNIRVKYDTSKLTEKEVRNTFNIKLRNRFQALEQEDEEERGEEVVDAKEEVERDFTIMKKALLEVAETVLGKPRKKNKPWISGESWSLIDERQQMNEKILSTRSERVKGQLRKKYREKDREVKRSLKADKKKWLEEIASEAEKAARSQHMKTLYGLTKKLCNERPRHSTAVLDKDGNLLSKKEEIQRRWTEHFREVLNREQPDNPIEPEDEVEFEFGELIEEISVNEPTFGEVKDTITTLKNGKSPGIDNITAELLKADPEFSAERVHKLLVKVWRHETIPNDWKKGLIIKLPKKGNLKECKNSRGITLLSIVGKILGRIVIDRIRNGVDKKLRKEQAGYRRGRGTTEQVFILRNIIEQVNEWQATLYVNFIDFEKAFDSVHRESLWVIMEKYGVPEKIIRIVRLFYEDFQCAVEDQGETGEWFNIKTGVKQGCNMSGFMFLLVMDWILRRSVGKGENGIRWKFTSKLDDLDFADDIALLSSTKHHIQEKTAKLDGEARRAGLKINLEKTKMLRINAKQHGNIVINGKEIEDVSEFTYLGAKVCREGGGMKDLRNRLSKARSVYTRLKRIWNSKKIMRRTKIKIYKSLVLSVLLYGCETWKMNKKDDKLLDVFQQKCLRRILKISWEDHVTNEEVQRRAGVHQLSSEVKRRRWKMIGHVLRQGRENDCSVALTWTPEGRRKQGRPKTTWRRTVERERGEAGWRNWDEVRSKAADREKWKSTVKALCATRHEEDR

SEQ ID NO: 3053 - protein, 1149 aa, synthetic construct
  source 1..1149: note = Description of Artificial Sequence: Synthetic polypeptide
MAANFLTPVFIAFLAILFNQKLHYSPNLTSGINGFGLNCILANSESILTGLEAFYSHNIRANKMNVGRSSSEHKHLLLCLLLLGGDIQLNPGPKWKFPCGSCNKPVKSNQKGIQCDNCNLWYHTRCCSINDDLYYTLAASSCTWLCVSCGFPSFSSSLFESSSIELQNSFSSLDSLHQDTQNISSSTIRSPETSPLDSSSRNSSNTRKQSKEKLTGMILNCNGLKGTDHITKFQALINLHDPDFILGTESKLCPDISTYSIFSQNYSVFRRDRNKFGGGVFQAIKSDLVCTEEPDFEVDNCEIIWTSLKLANRKSIYMSSYYRPPNQPSDSIDNLNESIRRVFNKVKNFPNIIIGGDFNLGDIEWNSSVPTPTNPATASLHQKFLQTIDDFSLSQHVKTTTRPSSGKTLDLLLTTYPNVIVNTSTASGLSDHLAVIFEVNLKPSRSLKPPHKVYQYKKANFPDLCKFMSDSSTTFFSTNPEKRTVEENWVLFKTSLSTGISQFIPQKSSRPKYKLPWINTNIKREMRKKDRMHKKAIKSKNQQHWEAFKRQRNLVSKLIKDSHNDYLNNIIGNSLKDNPKKFWSYVRSSKSESIGIPPLKNNDSSVSVTDAHKAETLNTFFHSVFTQEQLPTPVLGNSPYSSIPDLHISAEGVCKQLSELNPKKACGPDEIPANVLKEVSQSISHWLAFIFQQSFDCNKIPSDWSNALITAIHKKGLKSEPANYRPISLTSICCKIMEHIILSHMAKHLSSHNILINQQHGFREKFSCETQLISAIHDWAKTINFRGQTDVLLLDFSKAFDSVPHQRLLIKLDFYGIRGNMLNWIKAFVSNRKQSVSVNGTVSSSKSVVSGVPQGSVLGPVLFLLFINDISTSIQSNLRLFADDCVLYREVASLQDCQALQQDLDRLSVWSKTWQLKFNVSKCYHLGITRKKIPVKFTYSMDGKCITQASSTPYLGVTIADNLSWNEHCDNICKKANSTLGLLKRILSGCSPEVKDSAYRTLVRPKLEYATSAWNPYTQCNINKIEMIQRRAARFVFNDYSRYSSVSPMINSLGWESLEQRRQLNQAHMFYKIYNGLVGISFPPEVTPITRVSRQPNCAPFHQLVTLNDTYKYSFYPRTIRTWNSINLSTIPDSLAKFKDSLLLKVQTN

SEQ ID NO: 3054 - protein, 1024 aa, synthetic construct
  source 1..1024: note = Description of Artificial Sequence: Synthetic polypeptide
MINNPSNVVPVYFCLPILAFWSFLPCYFHLKAVDRGSHVATLTSEPVASTGWSYSNQELKTIRKSQPKQRLEPKLWQKLGDLGIRKPFRSRRKPRQSRHVCTGLPVVTTVDSTGHPQLSSGCSTNSSSSQTARFPVIPDTIIANMQSLLPKLDELYAAIMQFPAGIICLTETWLNESHPDPLIHLPGYLCFRNDRTTSRGGGVCTYINSQYPCRRLPEFEDLSIESLWISVRPYRLPRSVSTLLIGVIYHPPSNGEMNRQLVDHIDKNCESFLSKHPDGLVVVTGDFNPSSTGIKAQYVTHKTGLTQIINVLTRDTGILDWCLTNKPKYFQQPLQLSKMGSCDHYPILIKPNLSVTNPKAHKSSVWRRNLRRSNLDAFGRWITQFCWNTILSLQTAREKFERFYTVITDAVNTYLPLQRVQVCATNKPWIGTSLCSLIARRQKALTTLGKDSRLYKELRNQVQRECKVCRERYYPNKVAALKESNISRWWQEVKCLSGSVVSNEWWHQLMDDSTPSVQILAERFNEFLLGLTSNFAPISQQVTCSGPVPPELLITPGKAFKALSRIKVKKSSGPDPVPSVIWKEFAPELSDVVCNLYNSSLMEGFVPQELKESIVHPVPKCSPPKTLSEDLRPITLTSQLAKVMEGFALDSLFACVKDKLDPKQFSVSGKSTVLALVYFLHCILESLERGENYVRIFFADFSKGFDLVDHNVLMSELDLLGVNEYLQNWIAAFLTARPQRVKISGHTSSPVFPNGGIPQGTKLAPLLFAILVNRLASTWPYRIKYVDDTTIFEVIPRCSPSYLPFIANDICNFATERGMRLNPKKCRELVINFLQYQPSPVNALQLMGSVIKRVESYKILGVHISSDLSWNKHVDYVVKKANKRLYALRLLKKSGVPVQDLIAIYCVLIRSVVEYAGPVWANITGFLVDIVEGIQKRALRIVLPHLRYKEALETSGLQSLADRRRELCISLMTSAKELEPLRSVITGGVINNVHGYSLRSGSMNTYKHISVTKRFGDFVTYRFL

SEQ ID NO: 3055 - protein, 2244 aa, synthetic construct
  source 1..2244: note = Description of Artificial Sequence: Synthetic polypeptide
  VARIANT 2: note = Ile or Leu
  VARIANT 140: note = Any amino acid
  VARIANT 143: note = Any amino acid
  VARIANT 145: note = Any amino acid
  VARIANT 197: note = Any amino acid
  VARIANT 218: note = Any amino acid
  VARIANT 232: note = Any amino acid
  VARIANT 248: note = Any amino acid
  VARIANT 255: note = Ile or Leu
  VARIANT 265: note = Any amino acid
  VARIANT 283: note = Any amino acid
  VARIANT 316: note = Any amino acid
  VARIANT 350: note = Any amino acid
  VARIANT 358: note = Any amino acid
  VARIANT 392: note = Any amino acid
  VARIANT 405: note = Any amino acid
  VARIANT 411: note = Any amino acid
  VARIANT 418: note = Any amino acid
  VARIANT 423: note = Any amino acid
  VARIANT 465: note = Any amino acid
  VARIANT 516: note = Any amino acid
  VARIANT 909: note = Any amino acid
  VARIANT 958: note = Any amino acid
  VARIANT 1134: note = Any amino acid
  VARIANT 1141: note = Any amino acid
  VARIANT 1145: note = Any amino acid
  VARIANT 1174: note = Any amino acid
  VARIANT 1176: note = Any amino acid
  VARIANT 2015: note = Any amino acid
  VARIANT 2069: note = Any amino acid
MXKALHGGPWFILSHFLTVRGWEPKFKASSTQLTYSALWVRLPELPTEFYDLEILSRIGSKLGRLLKIDTCTSSTTRGRYARICIEVPLEKPLKTHLYIGNHRQSLLYEGLNLLCTYCGRFGHPTTSCPEVVRAPNEQNXRNXQXESNSTPDTIPSKENEWKTVTFTKKSIHPPKHLNFDKGKAATMAATPAAQPLXGQSSNPTSAVLGRVTSTRQVXLQGPVIEFNNKFQXLSNAGPSDLQTDHFYXGPIPKNXGTEPLLTQQXAKAHFHTPDKLPTSLPNXLPNDPKPRLSEPNPHLTKSPPLVGYNTFSQDYXTPHZPLPCNHLLTSSTQSSSNNSEGPLHILDTLXPTQNKAIXTMHATVTSLTSDSRLPQNPCKQHDEFPCEHHHEXPTTLFPSLPNIYXHSIQTXKPNTTLXAEPQXLPNPILNAETNLHRHEPESVSEGKYTNQQPVFSSPSSHNGGXSTASEFITSNLHISAHDHGPPSPILVGNGTAGICSNIHSATQQPRGGVANXKSDSFSRNSDRRNEAGNGSLQSKSMVHDPDSSSNGTPGFQFHSSAMAISNGPDESDLGPNSQSPTLLPTSSYGSGLCTLVPATGLIQSTLPLLEPTESSRESHPTKQSSTITSSISTRTRQRYKRGTDSNSCGDEGDKNRILVVKRDPILQPQRTVRKKFILKCPPEMVTCSLNFRQTTNPEVGKYAMVIIPTLLQLPLSLDPMTSSVVHPVTQAPMSQPRNPNSYMNFLVWNCRGSHNPEFRRHFRSLLDNHRPTLAILLETHMQDHASLREDFNFGNMAQAPANGLIGGLVVLWNADLINVTEMRISDQEIHCMVQVSPTKPPWILSAIYASRHYQLRDILWNSLINLHDNTAMPWLIGGDFNEILESKEKFGGLPMNNNRADKFANFMHXCSLIDLGYQGSRFTWTNKQRNGVPYTKKWRTILERLDRFLANYDWLNLXPNTTVIHLPRTHSDHCPLLINLEPPQPIQNRIFRFETMWASHPQFQQLVHATWSNDVPLLATTDNFKRVVTRWNQNTFGNIFQQKRKLLARLAGLQSSVHYPTSVFLQNLETQLTLEYSHILRIEEEFWQLKSRINWLNEGDANTRFYHLSTLHRRRRNRINALQDNVGNWVATTXEIHDLIXNYFXDLFQTDQLISENMTGNTYNCEISSDDILXLXSPLHQDEILTALNSFKAYKAPGPDGLHPIFLPKILDGCRIVLRHTKPQDQMGYIQFFYQKYWTDVGDKVSSFCQDVFCSKIIPPELNKTLICLIPKVKHPTRIQQFRPISLCNTVYKLITKIIVNRLKPIISKIIGPTQTSFQQGKRACDNAIIVQESLNYLAKMKGKYPSMLLKLDLEKAFDRLEWSFIRRALFYFNIPPSMISLIMSCVTTTSISILINGSKTQYFTPTRGIRQGDPLSPYLFIMCMELFSRSISLSVDYLKWQPIRLSNKGPLLSHLFFADDIILFSKITTKSCHAIIDVLNNFSKYSGQKINFEKSKLFFSKNCSSLIKILLLLPLTLKKEPLLVNTWDFLCSKQDPKMQISSSSLIISKINLLDKDFVITSFNIKEGTSFGKYLGFPMFQARPKNADFQFLLDNFKNKLAGWKSRFLTLAGRATLIKSTLNQLPNHIMQYIHIPAHILNKMDQYQRNFLWGTTLEKKKLHLVRWNEITRPKEAGGLGIQKLRQKNHALLASLAWRLFKTPQAMWANILLTKYLNTSPNNIHSQIWSNVINGWHQCQLGIKWNIGKGTHIKFWEDPWIGPGTTIRSKIHGPLPLDQQNITISSLINNKGWDWNKLPFELPITLLKVAHNITQIIQATYISKYSNKVDNIFWGLTPTGHFTTRSMYSILEAQHDVSTNSSTKYNWIWKLPVQPKIKGFVWLLHKKRLPTKDYLRHINLIQDATCQFCHQEDETIRHLFLDCTNAKTFWQDLGILDFINQKLHYTNSFNWVHDLITCKDFHFPYQMNPATYLPLSLWNIWLARNNNCYKHTMSTASAKLTTQQAAKFTYLVAKKHTXVKKRQQNLKWKPPKEHFYKLNTDGAHTTSKAGIGGLIRNSKAEWILGFAAAVPXDSSTSAELRALLQGLQLAYSHNLVPLEVEVDSQDIITLLYSNNVSFDNLTTDCRYFLDRLGKPVVLHAYREQNRVADKLAKAGCNFDIHSVVRILEDNPDFAWSVFEQERSAVQGHVLEHFRPHSDNYDTVNRYCNSDAVGSSINIGLYNTLAPTTGASACNRMQYRHPPSVRNT

SEQ ID NO: 3056 - protein, 343 aa, synthetic construct
  source 1..343: note = Description of Artificial Sequence: Synthetic polypeptide
  VARIANT 32: note = Any amino acid
  VARIANT 34: note = Any amino acid
  VARIANT 42: note = Any amino acid
  VARIANT 50: note = Any amino acid
  VARIANT 56: note = Any amino acid
  VARIANT 104: note = Any amino acid
  VARIANT 138: note = Any amino acid
  VARIANT 156: note = Any amino acid
  VARIANT 223: note = Any amino acid
  VARIANT 330: note = Any amino acid
ERKLYNFPNEYRCKNFKYQKDYNNISQEYIMXKXDLYQECRXGSILGKLXALIISXTKLTKIILSQMQKKAFDKIHPFLLKTLKSIRINGSFLKIISSIYLKPXASIICNGINMPFQDGNKDVHYHHYYSILYKCLQXKKKKLKELEAKKKQNYHXLQMIYTRILENQLKNYLKLSTKKLLEIINNFSKVAGYKINPHKSSAFLYITNKTQQQEIEREIPFKXTVDNIKYLGVYLPRQTQELYEHNYKTLFTQIKSDLNNWKNINCSWVGVNIIKMTILPKLIYLFSAIPIKLPKLFYRARKKYQNSSGRTKGQEYQGNKEMLGKVAPPXILNYIIKQQSSKP

SEQ ID NO: 3057 - protein, 935 aa, synthetic construct
  source 1..935: note = Description of Artificial Sequence: Synthetic polypeptide
  VARIANT 204: note = Any amino acid
  VARIANT 212: note = Any amino acid
  VARIANT 894: note = Any amino acid
MIPLTISTWNVLTLIDNTKSSRPERGTALVARELNRYHIQIAALSETRLANEGQLTEVGAGYTFFWSGHSEGECREAGMGFAIKTNLISKLVCLPKGVNDRLMTMLPLAGKHHATIISAYASTMTNPDEVKEKFCEDLETLIINVPKEDKLIILGDFNARVGSNYQTWQGVLGRNGVGNSNSNGHLLLKTCASHDLLITNTVFXLPKCNKTXWIYPRSKHWHLIDYVIVRRRDRQDVRVTKAMCDAECWTDHRLILSKLNIHIHQKYCPQGKMTTRRINVNKLELFSESEQFVADLEGKLSQHIVGNSGAEKEWAAFRDLVYSTAFAHLGQNTHKHQDWFDENDGEIQKLLNEKRELHRIYQQDSSSTSKKAAFNSIKSKVQAKLREMQDSWLSKKADEIQFYADSNNPKCFYDSLKAIYGPKTYGASQLLSADGATLISDKDMILERWAEHFHSVLNRPSSINAEAIDHLPQVEVNPSLAELPTEEEVLRAIRLLSCGKAPGADSIPAEIYKVGGPLLIQKLTEIFQVIWQEEVIPQEFKDASIVHLYKGKGNRLSCDNHRGISLLVIAGKILARVLLNRLILHLEDGHIPESQCGFRKGRGTVNMVFAARQLQEKCQEQNRGLYTTFVDLTKAFDTVSHEGLWKIMSKFGCLEKFINIVHQFHDGMFAWVLDNGQCSRAFPVTSGVKQGCVLAPMLFSMMFSAMLTNAFNEDEHSIKVNYHTDGKFFNLKRLQAKTKVEGVLVHDFLFADDCALNAASEAEMQQSMDQFSAACANFGLIINTKKTQVLHQPPPHHPYVEPSVTTNGEVLNAVDKFTYLGSVLSRDVHIDNEVDTHIARASSVFGRLRRKVWERRGIRLTTKLKVYRAIVLTSLLYACETWTVYQRHARKLNXFHLNCLRKILRITWQDKVPDTEVLAQAELPSIQTMLQRVQL

SEQ ID NO: 3058 - protein, 867 aa, synthetic construct
  source 1..867: note = Description of Artificial Sequence: Synthetic polypeptide
CLPPSLLVSLSSFELELFELGCSPPVLCAVVYRPPKYNKDFLNEFSGLLAEILLKYDRVLIVGDFNIHVCCPDHTMSKDFLSLIDSFNLVQHVSEPTQERGHTLDLVLTYGLSVSNLVICDAVFSDHMPVLFDITLPCSPCRPRAPARWVRIINPSTAALFSASFNQTSVIPQSTCSSTDELSSWLHSTCLTVLDAVAPLKSRQPKVKTEPWLNNVTRAARRECRKAERKFKKDKLQVSLQMLKDSWRHYQATVKEAKREHLSNVILLNRHKPRVLFSTIDAALNAPKSVCVQPTLETCETFLKFFVDKVNNVRALISPPGFDPSVVVSCPVTFDQFEPVTLSVLYETVKHLKPSGSPSDAVPPRLFKEVITTLGPAVLAVVNGSLSSGVFPRNCKHATVQPLIKKPNLDPSVLSNFRPISKLPFLSKILEKIVYVQLKDFLDENGNLEVFQSGFKSLHSTESALLRVFNDILLATDAGDHVVLVLLDLTAAFDTLDHNILISRLQQLVGIRGTALQWFRSYLEDRTFCVNLNNVQSSSAPLLYGVPQGSVLGPLLFSLYLLPLGSILRKHNCAFHCYADDTQIYVPITKKDAHSISPLIKCLEELKIWMALNFLHLNEEKTEVIVFGPSGNSESHPSHTLVTPESHPIALGSLTQSVKSTVTNLGVKMDNGFNLDKQISSVVRSSFFQLRQLAKVKSFLSRKHFETVIHAFVTTRLDYCNSLYFGAPHSSLSRLQLVQNAAARLLTGTWKREHITPVLASLHWLPVHFRVRFKILLFVFKSLNGLAPPYLSELLHLHSPSRSLRSADQLLLDVPRTRRKLRGDRAFAVAGPSLWNALPMQVRQARSLNDFKSKLKTHLFSLAFNSV

SEQ ID NO: 3059 - protein, 588 aa, synthetic construct
  source 1..588: note = Description of Artificial Sequence: Synthetic polypeptide
  VARIANT 308: note = Any amino acid
  VARIANT 585: note = Any amino acid
MRGSAGRKANTNWLRPLKEAPKPEEAASTTTPPPSFNMALFNVRSLSNKTFIINDFIHDYNIDGLFLTETWLSTDASTVLTEASPPNFSFVFSTREGKKGGGTASIMSNSFAVKQITLDEYPSFEHHAFVFNSPPVLCITVYRPPKPSSVFIEEFSEFLASVHTSFNMILITGDFNLHIDGKSDYCTTQFLDLLSSLDFKQHVMQPTHNRGHTLDLVISHGLPTSVSAVVDLAVSDHYCVLFNITGFIKQETSVRTVKKRYLTPEVVEKFITSVRSYSPPVLPAPCDLLVESFNSKLKSSLDSVAPLXSKKIRIKATPPWRTEEIKQLKRRCRSAERLWRKHKLEINYQLYQNQLKLYNQTVKQTRNSYFANIISVNKNNPRVLFTTIESLINSNVNKNTMPASASLCEDFADHFRSKIDSVRSNIIKGQKSLFIGNDGLILPEEALDSFDLVEAATLGRVFSQVNPTTCFLDPIPTSLFKSFYGSFESEILNIMNSSLQTGIFPAAFKTAVVKPLLKKTNLDPSVFNNYRPVSNLPFLSKVLEKLVFIQLNEFLLQNNIFEINQSGFRTNHSTETALLKIVNDXRCA

SEQ ID NO: 3060 - protein, 304 aa, synthetic construct
  source 1..304: note = Description of Artificial Sequence: Synthetic polypeptide
TYVRSAAGDSDRFGVSVGLHQGSALSPYLFLLVMDALTLNIQEEAPWCMLYADDIVLVGEDECEVQSRLEEWRVKLEGAGLKISRTKTEHLFCDFGGPTSFSPIALNGVPLPTCSDFKYLGSLVQSDGGVDRDVKSRINAGWMKWRQVTGVTCDPRMPLRLKGQIYKSIIRPVVLYGSECWATKVADERRLHVAEMRMLRWMCGVTRLDKVKNVYIRGSLKVAPVVEKLRSKRLAWYGHIMRRNDGDINQKVLRLNVDGYKGRGRPKKVWMDCVKEDMLKKGVDSDMTADRDVWKSSTYCADPP

SEQ ID NO: 3061 - protein, 1011 aa, synthetic construct
  source 1..1011: note = Description of Artificial Sequence: Synthetic polypeptide
  VARIANT 715: note = Any amino acid
  VARIANT 846: note = Any amino acid
MMATRKVRPPVPGGPAVPGYGSGQGNGGAGGAKNPRLGYGYHTRRPLALATLNTRTLRTDERIAELEEELSRLRWDIIGLSEVRREGEETIILKSGNLFFFREGDQQSQGGVGFIVHKSLVNNVVKIESVSTRVAYLILRISKRYSLKVIQVYAPTSTHSDDEVETMYEDISRAMHSSKTFYTVVMGDFNAKLGIRDGDELRMGKFGYGRRNHRGHLLAGFMEKEGLYMMNSFFKKQGHRKWTWMSPDGATKNEIDFIMSTKKQIFNDVSVINAVKTGSDHRIVRGTLNIDVKLERCRLMGSTLRPAPVHIHNAETFQLELRNQFECLGSSVDDLNDGFVHALQSVGSKFYKTHRKSSPKKLSDHTLELMKERRDMKLHSSDDAERYRRLNRQISTSIKRDIRRFNTNRVKLAIERNQGSKVFSRDLSIGQSQLLKLKTGEGRVVSSRPELLSEVERFYGQLYATQEPVTDLVEDPRARLTRHYTEDIPDVSLDEISMALKQLKNNKAPGNDGITAELLRAAGEPALKVLQKLFNSVILEGHTPKAWSRSVVVLFFKKGDKALLKNYRPISLLSHVYKLFSRVITNRLARRFDDFQPPEQAGFRKGFSTVDHIHTLRQVIQKTEEYNLPLCLAFVDYEKAFDSVETWAVLQSLQRCRIDYRYIEALRCLYENATMSVRVQSEDTKPIHLQRGVRQGDVISPKLFTAALEDVFKVXKYCHLPETLHRGVGRRFQGPEILVVTYTFLHVTFRVQVIGSLLLLRILIKIGTMLEDLNRASERVGLRMNMDKTKVMSNVHVSPTPITIGGHTLEVVDEYVYLGQTIQLGRSNFEREVNRRIRLGWAIAKXNNRRSGSCGISSRPKTYRSVSRQKSLTSVCCQHTGQRRGHSLRATSGGSKSLKGQWSGQCSESLCEIASGTMRSAAESVTDIARRIANLKWRWAGHIARRTDGRWGRRVLEWRPRIGRRSVGRPPARWTDDLVKVAGVHWMRAAQDRALWQSMGEAYVQQWTTYG

SEQ ID NO: 3062 - protein, 310 aa, synthetic construct
  source 1..310: note = Description of Artificial Sequence: Synthetic polypeptide
  VARIANT 28: note = Any amino acid
KSEHSRQVRSRRNRQVQCGCGPAPGIGXSPYLFLLVIDALTVEIQEEAPWCMLFADDIVLVGEDALEVQSRLERWRDKLETAGLKISRAKTEQLFCDFGGLSSFIPIALDGAHLPVCSDFRYLGSLIQSDGYIDRDVTNRIKAGWMKWRQVTGVICDPQIPLKLKGKIYKAVVRPVMMYGSECWAVKGTDERRLHVTEMRMLRWMCGVTRMDKIRNEYIRGSLRVAPIVEKVRSKRLAWYGHVMRRDESHVTRRTLVMSVEGYIGRGRPRKRWMDCVKGDMIKKGVMTEMTYDRVMWRTKTCCADPTGVG

SEQ ID NO: 3063 - protein, 1024 aa, synthetic construct
  source 1..1024: note = Description of Artificial Sequence: Synthetic polypeptide
MMRPRSSSLSLTKPNQIKQLNTSNQKRNNPNPAGHRGVARPLPPKSMSSGSKLKSKLYLATLNVRTLMEDHRLIELEHAISQIKWDIIGLCEVRRSGDEIREYNKYIFYYKGEKKGRRGIGFLINKYLKDKIISFEGISDRIAVLNILNGFKHPMSIIQAYAPTEQDTNAEKDKFYEKLTEVIQKSNKNIIVMGDFNAKTGVKSNKDEFVLGKNSCGERNENGQRLIDLCFASNLKIANSFYKKEKSSGRGCLQTEGTEMKLISFQFLQKRKVKWTWMSPNGRNRNEIDFILTRETRILSDVSVINKLNFSTDHRMLRGTLICEDKNSRKHIISNKNGKTITVPHNILEDIEKTLQDIKKQQTIQDKYDFLEKTLKEVNIFGTKRGKRNKLNEETKKILEERNELLDNRRENRHSIANISKKIQSSIRKHRKEERLKTLKEQIEKTGGMTKGLKQLKEYSQWIPNIKLQKKKETYRITSRRSSIAKTATEFYKQLYTESGESIVASKNIIEEGDSNEEEIPTILETEVAGAIRSQKNDKAPGDDKIPNELLKSTLSSITKALTILFNEIINSEQIPVQWTKSTITLLHKKGDKQDINNYRPISLMSNIYKVFSKVILGRVTQTLDANQPREQAGFRADYSTMDHINVVKQIIEKCNEYGQNYYLAFVDYSKAFDSLSHNYIWKTLASQGIERKYINIIKEIYKNSTAKIQLEQVGEEFKIERGVRQRDPLSPKIFTAVLENIFRNIDWDKFGININGTKLNHLRFADGIVLFAETPETLRTMLQQLDQESRRAGLSMNPMKTKLMTNAEKDIIELRHEIIEYVDEYIYLGQIISVNQHSKEIDRRISNAWKRYWSLKEVVKKKSIPMSIKTKLYNTCILPCLTYGCQTWPSTTKHNLKLANCQRHMERSMLDIKLRNRWRNVTIREKNKSKEKKTKVNDVFKKIKKLKWNWTGHIIRTNKGKWTKDIMDWYPREGKRQRGRQIKRWEDDLPKGWRRLARDRETWKKLGEAYVEGQPDTQLDAGK

SEQ ID NO: 3064 - protein, 1446 aa, synthetic construct
  source 1..1446: note = Description of Artificial Sequence: Synthetic polypeptide
  VARIANT 860: note = Any amino acid
MGGNKKGRNKTQFKPVILNSTDDLDQELEPQETRGVNECTLCLTSKQSKMIQCVLCEENNFHASCLALNQSGRYHAPVCPSGHGCSVNERSTEKQHWVCTGCRGPTTNATPKVACTKCEFLFCAPCAKLRPGMIDMFNRFPKSFMWNCERCLQVSTQNRKCVASDTKESVGESPKTAGEEPLQKYAETGDHDVKEISYEIAQSTVQKRSSSGGDWISKNEKKPRICKYYAKNQCKYGISGRGCKFFHPKRCPRFMKYGRQGCNSKRECNFFHPWLCQESFRNGTCFDTTCPEIHLKGTIRAAPTAHHRHTHAERGENSGRPWQNSNRIQTNKYGENNHQYNVERDITANDRDMSVYNQDVRRDLQNMQNFLQTLYEKISSMETYMEKVQHGGPRAPWNPPRVENPTQLWGDPGTTHQLKTQTAIHHAKQNEHQELKSNKDEILSKVHVINIRGLLTKNCRKQMVLQDIINDAGSKLLAVTETHLDDAVNDAEVKIENYVLHRSDRKDRKCGGVALYVRDHLGSHTKQKFSNGVCDCIIVNIEKLRLMCVVCYRPPKCTTEKFAEMLQVINTHCKEVQSKYQLYITGDFNFPFLKWLTTDLPDETGSFVLSRTSSATRDEKDQALSLVRIMEEFSLTQMISSPTRNENVLDLLFVDNAQLIKNIEIQDTTLSDHRLVEITTQLGERDSHRPQKNSQINSISSLRDLNVHDKGINWDGLNAELQSVNWDVLLNNSIESESINETFENILLEKCMKYLSPAKRKFNKSRHHKFRKGLLKKRAKLIKCQQSTKLLQRKSECKKKLDEIERQLARSHDEEKQEKEKKAIEKIKSNSKYFFAYASHHSSVKSKIGPLVNDTGSIVXDDQEMSEILSRQYQKVFSDKIPNPEIPRIDLTTNYLTDFEFTKLSIELAIDELSGNSAAGPDDVPAKILKMCKLSISYPLYLMWRKSMDDGVVPLTYKHAIISPIPKAGNSMDPANYRPVSLTSHVVKTFERVFRKHLVHHLESNNLLTSNQHGFRHKRSTTSQLLEHYDSILDLLCQGKSVDVIYLDFAKAFDKVDHGILLLKLFNMGIRGKCLRWIEAFLTNRTQSVIINNKVSKRQPVLSGVPQGTVLGPILFLIMINDMGHQCKFAVPSSFADDTRILAAVQSTADVRNVQLDLTNIFHWTSVNNMTFNESKFELLRYGKNFSLTESTSYTTRDGSEIERKQILRDLGVRIQDNATFEDHVARVVTVGKKWSGWVLRTFSSREADTMLTLWKQLILPRIEYCSPLWMPSKRKDLERLEAIQRSFTAKIRGMKDLNYHERLAQLQMYSIQRRFERFTIIYVWKILEGITVNVNGRIQARHSNRIGRTCEVRIPIKTGGDAIATKYSNSFVVRGARLFNKMPRHIRNVTGTETAKFKHLLDACLLKVPDKPAVSGYVNCGDNSLLATPLVTDCSITSAQDGWRA

SEQ ID NO: 3065 - protein, 931 aa, synthetic construct
  source 1..931: note = Description of Artificial Sequence: Synthetic polypeptide
MVYVYLLFFACLITRYPDVEENPGPRGFGSRSCRILCTNVRGLYGNLAELAVASSNYDLVLCSETLVSSHRHVSELMIPNFEKPVLRLRDSCPGFRGLAAYVRKGVVVSRQSEYECPCCEMMVLRVCGSFRNFYLFSVYRSPSADDRVFDCLLDAMARIQSSDRRSAFAFMGDFNCHHVEWLGSGRTDCHGHAAFDFASASGCEQLVEGPTHLMGGVLDLLMTDVSDLVGVSVVSPIGSSDHGALSATLQVRQRVPRVTVRREIFLKSRVNWDAVSGAILALPWGVVRESTDPGSTLDRLLSDMVRAYVPSRFITVRTGDEPWFDDACRRAHQLKREAYARWRTSRSAVDFQLFREQRRRAGATYEEAEREHNLRSRELLASSVSAHKWWSTLKSAVLGVSSSVPPLIGTGGDLVADPAAKADLLLRYFDGKQSRDRVRIPLACDPEPRFSGFAFRSSEVHRLLLDLDPYGGTDPSGMFPFFLRRVAGVLAAPLASVFRRMLRLGSFPECWRVAHVTPVPKGSVSSRTSDYRPISITPVLSKVYERLVASRLGCFLEKQGVLPPTQYGFRKGLGTCDALLHISHVLQLALDGGHEARLVQLDFSAAFDRVNHLGLLHKLRLMGIGGSVLAVISQFLSDRRQCVVVDGKRSEFLDLVSGVPQGSVLGPLLFIVYTADLFHLVNNLLVGYADDVTLLAVCDKPSDRLEVSESIQHDLEMIDSWCSRWGMRLNAGKTKTMLVSRSRTVGPPFPALMLDGVSLPVVDDLVILGVNFDPKLTFEPHIRSVASRASQKIGLMRRAWRVFGSVELTRRCFNCFVLPLLEYCSVVWGSAADCHLCLLDKVVRRCAFMLGGVVPCDLAHRRRVGGVCFLYKIYNCPSHPLSEFLPDPFVRVRYTRRTGALHEFALEPLRCRTGQYSRSFFSIVCGCLEWS

SEQ ID NO: 3066 - protein, 1669 aa, synthetic construct
  source 1..1669: note = Description of Artificial Sequence: Synthetic polypeptide
  VARIANT 285: note = Any amino acid
  VARIANT 578: note = Any amino acid
  VARIANT 1033: note = Any amino acid
MKQCDECHSVFPLEFFYYEEVELESCKYCCKIQALQAEIEKLESDREAMQRGDGGEKEKAPREAHLRLSSPSPWKTVMRNKRQRRSTGAILEQTNHIKVNNRFAAFNDGDDNVATSVRPKIKLKTVNGEQHRGPPQSRDQKKSETSVQPPSHERERNPAPIPGQRAIKTFLIGDQIIKGQYYAFKRGCNDRKVICRPQASTSDATAILKDLRCKKMDHVIIHVGTNDLRTYSETQLQLVKDLIAAAKKKSDHVTLTSILPRLRAGNRLYSRIRYINGQIKREAEXNGLEFIDLFPSFDDDWRLFLPDGVNLNGAGHHVLGEMLLAAAASETAALEEGLRTRPKTIIEQPRHPAPFHALPADLPAMEQTATNVPAAVPCNPQISSPSGMKVGDPKGNEGTIITNSLDTDEEEITPTPDASVQMSRLGPPPLLPSIVSNLVSTNSNMSEGTDVPQPTNARQTDLDSSNTERGSPVSVSKEKSQSQTPVAKKRGQFPRTSSIPAHEGNRSTRKSGARNIPPKTNSCQPPQTRITRSKANSAGNDLLSARLGGKRPIVRQIAADVKQSDNCQAEIQNISLAXLQTGALAATDNAFADLTPPIFSQQSDAPSVSVTRRSNANTSVKFLFGNVQSITNKMNELQAIAATLAYDVIALNETWINLSNKNLEAEVALKGYKLFNIDRPTETGRGGGSIIYIKEHLNPLCKGFAATKEYEFITTHARLGIRQSLNIMLAYRSPRSTAETDAALYNKIENALNTPNETILMGDFNLPQIDWSTLCSPAPGSKLLELLSHHHLTQHVNEPTRYGNILDLVFSTPDCEIVDLAILDRLGDHNMIEFTLKTGNEFTTNASRLKLPDYRRANFQGMATEIETTDFETPMRDASVEQCSHILKTSILRAAERYIPNKRVRISNDPLWMNRTVKRCIAGDKCVTKPGSVIQQRRTGPVTSPLDESDSQTLHCRRQVRYKAWKRNPTEENRSSHIRACRDVKKIVRTTKREKEVSVAAMAKRNPKAFYKYVNERRLKKETIGPLKRPDGXITNDLRDKATILNDYFTSVFTVENVTNIPEPAPMQVAPINTCVFTEIEILQELTHLNVYKSTGPDNLTPRVLREMAPVIVKPLLEIFNRSLRTGEVPQDWKLANVIPIHKKGDKKSPSNYRPISLTSVVSKTIERLLKKRITDHLRMHQLISDTQHGFRNGRSCLTNLLDFFSKVTDIKDEEKGVDLVYLDFQKAFDKVPHQRLMKKLEAHGIQGDYLRWIRAWLTGRQQRVKLEGETSDWTQVSSGVPQGSVLGPLLFSIYINDLDLNIRSKISKFADDTKLCHPATKRAELQQDLDHLMEWSTTWQMSFNVDKCSVMHVGLVNPSTPLKMNGTELAAVTQQRDLGITITNKLQHSQQVDKSVKMASRVLGFITRNFEYKSKDIIVPLYKALVRPHLEFAVQFWSPHLCKDIDNMERVQRRATKLIPQLRNKPYECRLKELGLISLEQRRLRGQLIETFKYLNGFNDVPTTGLFERDLNDRLRNNGQKLKHKARRTTLSQQFFPYFIVSIWNRLPSDVVSAESVNAFKNRLDIHWERHPPQLRTPPPGVASSELLLQESQALNGQSFRGHLNPSSSLSRSNYTSLSSAYQRLLIVLACIHDRLFGWDSSPPSFSFFFLFLPFFSSLSPVLYILLT

SEQ ID NO: 3067 - protein, 1092 aa, synthetic construct
  source 1..1092: note = Description of Artificial Sequence: Synthetic polypeptide
  VARIANT 894: note = Any amino acid
MPCSGLFSAASYHPDWRCPSCAPQPPRPPSPPPASPLSPHPTNAPPLIVMQFNCNGLLHCRSELSAFLHSSNIAIAALQETKLTPSSSLPVFPGYTPVRKDRPAANGGGGLLFLIRQDIPYQQATTNHLFPNDHTVEHSGVTVTLCSSSLTLINIYVPPATSCPPGYRLDSSALFADSSADTLIMGDFNAHNTDWYSVTQDARAAARGEEISASINNGPYCLLNGDSPTRVPRDGPGSSPDLTVISAHLALDYSWSTTTTLSSDHLPILITAESSDSAPSGPRRTFVNFRKANWEEFTRECEELITSLPLPSSCSGGLRALNRALLSAAKHHIPAGHRKEYIPRLTPDARDAISRRDHLRSTSPHDPSLPQLQQEVDRLICGAAQEAWKQTIQDCDPKSNPSKFWSLLRSLSGKQSSVPRNQPISFGTHTFTHNGDIARGFCKQFTATSPPALATPPRLARRLLRKRHPIAHGFSPFTPAQVREAIVASGSSTAVGPDQLSILHLRHLGPQGIIYLTRLYNLSLAHADIPALWKLAVIIAILKPSKPADKGSSYRPISLLCPAAKVLERLLLPFINEAYQPAPHQHGFRPMHSTTSALLPLAFQATRGMNKPKPHDRTVALLIDFSKAFDTVPTEGLLSSVSGTTLHHNVVRWLAAYLRGRAACCLYNGSRSQFRAVKAGVPQGSVVSPSLFNLYVSDFPIPRDQLCYPSVTSYADDFTVVASHRDPLTAAAALSDHSASVSNWAANKGLTISTSKSNSTLWTTDTHQSTLDPGITMNDSALPLERRPKILGVTFDTHFTFTPHITSTAARASSRLRLLKALAGTRWGQCKETLLLTYRAFVRPLITYAAPVWYPGARQSAVRKLQTVQNAALRTATGCLRMASVDHLHAESKXLRIDQSLDLQCRQYLVSALRPEHPAHSVVTAQAGPRLIRHNLATKFQPDINHLLTDNIMPSPEYRSAISSLHRSAVQASLDRLPVNRVLGFAPPEISPDEAVLSRAARSTLSQLRSGFCSALMSYRHRIGLADSDSCPECHRAPHTVNHLFECPAHPTALLPTSLWDSPLSVTDFLCSLPSFSYLPPHARPPPEPPPT

SEQ ID NO: 3068 - protein, 943 aa, synthetic construct
  source 1..943: note = Description of Artificial Sequence: Synthetic polypeptide
MHRARSEKGGPQFRMEKIVQSTGYLKCLYTNARSLGNKQEELEALAQAKKYDLIGITETWWDDSHDWSAVMEGYRLFRKNRQGRKGGGVALYVREHYDCSELQYKEGEKLVESLWVRFKGANSSDVVVGVCYRPPNQVDEVDEAFFEQLSEASRSQALVLVGDFNHPDICWETNTAVHRQSRKFLENVGDNFLVQVLKDPTRGRAQLDLLLTNREELIGDVEVGDNLGSSDHEMVDFRILTKGRKESSKIHTLDFKKADFDSLRDLMERIPWDVNMKGKGVQDSWQYFKEALLKAQKETIPTRSKRGKPGRRPDWLTGEILGVLKHKKEAYRKWKLGQMTREELKCIVRECRGVIRKAKAQMELRLAKDVKDNKKGFYRHVNKKKVIREGVQSLMDEGGNLVTEDVGKAEVLNAFFASVFTDKVGSWTSVLSDARWEEDGQPLVGKEQVRNYLEKLNVHKSMGPDLMHPRVLKELANVIEEPLAIIFEKSWRSGEIPDDWKKANVVPIFKKGKKDDPGNYRPVSLTSVPGKIMEGIIKESILRHLNERKVIRNSQHGFTKGKSCLTNLISFYDEVTGSVDMGKSVDVIYLDFSKAFDTVSHNILASKLRECGLDKWTVRWIERWLEGRAQRVVINGSMSGWRSVSSGVPQGSVLGPVLFNIFINDLDEGIDCTLSKFADDTKLGGEVDTLKGRDRVQSDLDKLEDWATRNLMRFNKDKCRVLHLGRKNPKHSYRLGTNQLSSSSAEKDLGVTVDEKLDMSQQCALVAKKANGILGCIKRSIASRSRDVIIPLYSALVRPHLEYCVQFWAPHYKKDADALERVQRRATKMIRGLEHMTYEERLRDLGLFSLQKRRVRGDLIAAFNFLKGGSKEDGERLFSVVTDGRTRSNGLKLWWERSRLDIRKNYFTRRVVKHWNGLPREVVESPSLEVFKSRLDKALAGLI

SEQ ID NO: 3069 - protein, 1049 aa, synthetic construct
  source 1..1049: note = Description of Artificial Sequence: Synthetic polypeptide
MIPGLTEDLRSISNPRKTAVINNELRRLRMDIVALQETRLSSSGCLREKDFSFFWHGKPPEETREHGVGFAIRNNLVGSVIPPNVGTERMLKIQLQTSVGMANIFSVYAPTLTSAQEDKDKFYDELSIAISEVSSHEPLFILGDFNARVGSDHHSWPSCLGQFGTGKMNENGQRLLELCSQHDLCVTNTFFNVKPQHKVSWRHPRSKHWHQLDLVLTKRSRLGSVRVTRSYHSADCDTDHLLVCSKVYIQPRRFFRSRKEGRPRIDTGKTRDPSKVCEFVQALEEALPRRDDTDISKRWEQLRDAIYDTAISIFGKKTVKSADWFEAHTEVLTPLIEKKRQALAAYRSSPSEENLQALRFARSQVQQVARRCANDYWLQLCSKIQQAADTGNMRGMYDGIKQVIGPSQRKTAPLKSATGEVLKDRTKQMERWVEYYSQLYARETVVTERALNAIEPLPTMTELDAEPTMEELSDALKALSSGKAPGKDGIPSEILKCANGTLVSELYGILCQCWREGSVPQDMRDANIVTVYKNKGDKSDCNNYRGISLLSTVGKLFARVVLKRLHVLAERVYPESQCGFRAERSTIDMVFSVRQLQEKCREQNKPLYIAFIDLTKAFDLVSRKGLFAILAKIGCPPTLLSIVRAFHDGMRGTIVYDGSTSEPFEILSGVKQGCVLAPTLFGIFFAVLLKYAFGTATEGIFLRTRTDGNLFKLSRLRAKTRVLTKRLREFLFADDAAIAAHTLQELQSLITRFADACMEFGLTISLKKTQVMGQSVGNEPFISVLDYELEVVHEFVYLGSTISDNLSFDSEINKRIGKAATTFSRLTKRVWANNKLTVHTKVQVYTACVLSTLLYASETWTLCSKQEQRLNTFHMRCLRRILGISWQDKIPNSAVLERAGTVSMFTLLKQRRMRWLGHVSRMLDGRIPKDLLFGELASGKRPKGRPKLRYKDTCKRDLSALSISANTWHSLALDKYAWKQGVKEALAMYETTLVKEAEDKRALRKIRARDTRATSAYCCSQCGKDCHSRIGLHSHRRRCSNQSNRGANP

SEQ ID NO: 3070 - protein, 841 aa, synthetic construct
  source 1..841: note = Description of Artificial Sequence: Synthetic polypeptide
MLLVYRPPRCTADALLELADVVSDVALRTPRLLVLGDFNIHAEAVLSGPARDFMDTMTTLGLSQEITAPTHVAGHTLDLVFWTKGDRVLGIRDVATLPLSWTDHYLVKFRLSADLPLHRGGGPIKMIRPQRLMDPEGFLRSLRDCSAIMANGPVDALVDTWNTEVARAVDMIAPKRPLRASRAKFAPWFSGELMAAKRSVRRLERRWRRTRAESDRLRVRAELRAYSVAVLTAKKSYFSTRIASAQCRPAELFRVVRGLLQSGTRDEMEEPLAPRCDLFAKHFADKIARIRLDLDSGCCVSGAQNVLSAPPSLFSLDQFQLLQTEDVDKVLGGVRPTTCSLDPCPSWLIKSSREGMTGWVQGIINASFRSGMVPAALKEAVIKPLLKKPSLDPRDLNNYRPVANIPFLGKVLERAVALQLQAFLEETDYLDPFQSGFRPGFGTETALVALVDDLRREIDRGSASLLILLDLSAAFDTIDHGILLERLAELGIGGTVLQWFRSYLSGRFQKVELGGCYSTPWRLCYGVPQGSILSPMLFNIYMKPLGEVIRSFGGRCHQYADDTQLYFPVTSEPGVAATDLNRCLEAVMDWMKSNKLKLNPDKTEVLWIRRPSVRECGVVPVLDGVTLPLKEQVRSLGVLLDPFLTFENQISSVARSAFGQLRLIRQLRPFLNKHDLATVIHALVTSRLDYCNALYVGLPLKSLRKLQLVQNAAARVLTNTRYTEHIMPVLRQLHWLPVCFRAQFKVLVMTYKALNGLGPGYLKDRLLPYEPARGLRSAGEALLRVPPLMEIRLTSTRSRAFSAFAPRLWNSLPRDIRMAPTLALFRRQAKATLFTRAFIGV

SEQ ID NO: 3071 - protein, 815 aa, synthetic construct
  source 1..815: note = Description of Artificial Sequence: Synthetic polypeptide
  VARIANT 31: note = Any amino acid
YLRDFTEKPKSMNPCSHESFKSRINALYGEXFHLSVRAFNRQRDKKSQLIETLTFLKRCRDNKVIPIAFTLTSAAVSSPNSKRILFNASLSLISERIRVLRFELDSLDKTLLQSHLMLTQKMSPSDWNHVDNMTAASADSLSAKCKANLIAKFNLLSKKKPEPHITKLDVNKIVINQSNIPISDNLKTVLAKGLNFAVTPKHIPVEDIISQVDVALKGIGHIQADVARAEIATILKNAKKPISNISKNERSELANLKKRDDIVILSADKGNATVIMDKNSYNNKIQDLLNDGSYSKIKSDPTNSLTIKTNKIITSSTSLIEPTKRPSLKPSAARPPRFYGLPKIHKEGTPLRPIVSTINSPTYKLARFLSDTLLPFTGKTTSAVLNSTQLVSMVKDIVLSPDDILVSFDVVSLFTKVPVPDTITIIEDLVQHGLNPDVPALVRHCLTNTYFTWNGTFYKQNEGTPMGSPLSPVIANVFMEKFESDAIQTSTLRPSLWKRYVDDTFVIWPHGLPALNHFLDHINSRHPSIKFTMEVEKDGKLPFLDVLFERRTDGSLGHSVYRKSTHTDSYLKPDSHHHPAQKNSLIKTLYHRAHCISDQHHLASELKHVHLALKMNGYSDRTIRQAVSPTIQKQPPDTPIKIITLPYIAGVTKKISKILNKHKDPGPVQYSTQNPTNTKIQVRFNTVHKIRDLIPSVKDVIPDLQYPGVYKLSCTCGDCYIGETKRHISDRIREHKSDLKHGRTNSSAVADHCFNTAGSHDIVFSDTKVLCKPPGYYQRFVHEAIQIYKHRHNFNREDGFKLSNHWKDVINQVKL

SEQ ID NO: 3072 - protein, 490 aa, synthetic construct
  source 1..490: note = Description of Artificial Sequence: Synthetic polypeptide
  VARIANT 93: note = Any amino acid
IHKEGTPLRPIVSTINSPTYKLTRFLSETLLPFTGKTTSAVLNSAHLVSLIKDISLSPGDLLVSFDVVSLFTKVPVPDTIAIIEDLVQQGLNXDVPTLALPYQHLLHLEWYILQTRGGYPQWVLPYRQWCANFGTALPTLTSPGMVHSTNKRRVPPMGSPLSPVVANVFMEKFETDAIQTSTLRPSLWKRYVDDTFVIWPHGQPALNQFFNHINSIHPAIKFTMEVEKDGKLPFLDVLIEKRPDGSLGHSVYRKATHTDAYLKPDSHHHPAQKNSLIKTLHHRAHCISDQHHLASELEHVHQALRMNGYSDRTIRKAVSPAMGRQPSEDPIKTITLPYIAGVTKNISKILNKHKIQVRFNTVHKIRDLIPSVKDVIPDMQYPGVYKLSCGCGSSYIGETKRHVSDRVREHKADLKHGRTNTSAVADHCFNAVGTHEIDFSKTKVLCKPTGYHQRFVHEAIQIYKHRHNFNREDGYKLSNHWKDVINQVKS

SEQ ID NO: 3073 - protein, 521 aa, synthetic construct
  source 1..521: note = Description of Artificial Sequence: Synthetic polypeptide
  VARIANT 376: note = Any amino acid
QPPGYENQQYITDSTSLIEPTKRLSLKPSAARPPRFYGLPKIHKDGTPLRPIVSTIDSPTYKLARFLSETLLPFTGKTTSAVLNSAHLVSLIKDISLSPGDLLVSFDVVYLFTKVPVPDTIAIIEDLVQQGLNADVPALVRHCLTNTYFTWNGTFYKQVEGTPMGSPLSPVVANVFMEKFETDAIQASILRPSLWKRYVDDTFVIWPHGLPALNQFFNHINSIHPAIKFTMEVEKDGKLPFLDVLIEKRPDGSLGHCLQESHPHGCLSKTSKRDQMAHWDTVYRKATHTDAYLKPDSHHHPAQKNSLIKTLHHRARCISDHHHLASELEHVHQALKMNGYSDCTIRKAVTPTVGREPPEDPIKTITLPYIAGVTKXISKIMSKHKIQVRFNTVHKIRDLIPSVKDVIPDMQYPGVYKLSCACGSSYIGETKRHVSDRVREHKADLKHGRTNTSAVADHCFNAVGTHEIDFSKTKVLCKPTGYQQRFVHEAIQIYKHRHNFNREDGYKLSNHWKDVINQVKS

SEQ ID NO: 3074 - protein, 980 aa, synthetic construct
  source 1..980: note = Description of Artificial Sequence: Synthetic polypeptide
MAAHTVAAAQCLPGRCLVWLFMYALCLVLCTFCRASNTFSRHDLLKIGLCYERSVTSEFLRLHKIPVELARSPGSPWIIIPAGRRRRRRRERRQKRGCRAGALARLRRQPLKPPLPSLFLTNARSLANKMDELRLQTTANNVVKDSCILLFTETWLHSSIPDSAIELAGYTAQRHDRTVDSGKSRGGGLCVYVNNSWCTNTVTVDSHCSPDLEYVTVKCRPIYLPREFTVVMITAVYIPPDANANSAIGLLHGSISIQQSKYPDAVQIIAGDFNHADLKAALPKFHQHVKCATRGTKTLDKVYTNIKLGYRARPLPHLGQSDHLSLLLIPAYAPIKKTAPTITKTVATWPEGATQQLQDCFDRTNWGVFEHQDLEVFTDSVLCYIKNCIDTVTVDKRIRVYPNQKPWMTREVQQLLKERNIAFKSRDKALYSTARANLKRGIREAKADYRRRIEERLDSNDSRQVWQGVQHLTNYRANLGAADGDTALAEELNLFFARFEVTPPGTASPNPTVHSSLNLTVEEHEVRRTLRAVNPRKAAGPDGVPGRVLRDCADELAGVFTRIFNLSLEQSTVPPCLKSSTIVPLPKKTHISSLNDYRPVALTPVVMKCFEKLVRSHIIATLPRSLDPHQFAYRANRSTEDAVATALHAALSHLEQQGSYVRMLFVDYSSAFNTILPHKLVVKLGDLGLPHSTCMWIHSFLSGRRQRVRVGRHTSTALSLSTGSPQGCVLSPLLYSLYTHDCAPVHHSNTIVKFADDTTVVGLISGGDESAYRDEVERLTAWCRGNNLLLNTAKTKELIIDYRRKKTDTPPLTINGDCVERVADFRFLGVHIGEGLTWSANTSELLKKAQQRLYFLRILRKNNITQKLLVSFYRASIESILTYCICVWYTSCTVAQRKALQRVINTAQKIAGCPLPTLEELHSSRCIKKAQNIIKDSSHPGHSLFELLPSGRRFRSVKTRTNRFKHSFYPTAITTLNTAN

SEQ ID NO: 3075 - protein, 521 aa, synthetic construct
  source 1..521: note = Description of Artificial Sequence: Synthetic polypeptide
  VARIANT 6: note = Any amino acid
  VARIANT 9: note = Any amino acid
  VARIANT 11: note = Ile or Leu
  VARIANT 15: note = Any amino acid
  VARIANT 31: note = Any amino acid
  VARIANT 63: note = Any amino acid
  VARIANT 88: note = Any amino acid
  VARIANT 89: note = Any amino acid
  VARIANT 106: note = Any amino acid
  VARIANT 126: note = Any amino acid
  VARIANT 166: note = Any amino acid
TTYNNXIQXLXNDGXYTKINRDPTNRLATKXNNIITNSTSLIDSNKQRSLKPSAARPPRFYGXPKIHKEGTPLRPIVSTINSPTYKLXXFLPETLLPFTGKTTSAXLNSAHLVSLIKDISLSPDDXLVSFDVVSLFTKVPVPDTIAIIEDLVQQGLNPDVPTLVRXCLTNTYFTWNGTFYKQNEGTPMGSPLSPVVANVFMEKFETDAIQTSTLRPSLWKRYVDDTFVIWPHGLPALNQFLNHINSIHPSIKFTMEVEKDGKLPFLDVLIEKRPDGSLGHSVYRKATHTDAYLKPDSHHHPAQKNSLIKTLHHRARCISDQHHLASELEHVHQALRMNGYSDRTIRKAVSPAMGRQPSEDPTNTITLPYIAGVTKKISKILNKHKIQVRFNTVHKIRDLIPSVKDVIPDMQYPGVYKLSCGCGSSYIGETKRHVSDRVREHKADLKHGRTNTSAVADHCFNAVGSHEIDFSKTKVLCKPTGYYQRFVHEAIQIYKHRHNFNREDGYKLSNHWKDVINQVKS

SEQ ID NO: 3076 - protein, 1025 aa, synthetic construct
  source 1..1025: note = Description of Artificial Sequence: Synthetic polypeptide
MTTCSRSSLLRAKAQRMSSHRRPNARQRYPGLKSNSTESISQGQSNVNVGPSLRIMQLNIEGLSSAKCDYIAKILQFQDVDVLALEETHLDRQCPRSKIIGYTLIAASHHPKHGLATYVKNDLKDTVQVVPHTSPHYIAIKINDVTVVNVYKPPGMEWPCPALPQPSHPIIHIGDFNSHHTLWGYSANDRAGEQLTSWAAAEDQHLLYDAKDRGTFKSARWKKCYTPDLCFVSRDQNGNPMPSTRTILDDFPNSQHRPVVIHIGLQIPLFRCAPKPRWNLRSAEWVNFTADLEESVGMIPPRAVNYRRFVGLIKAVAKANIARGFRKVFTPCWTPESEQLFRKFNADKKQETAKALLESLNLQRRERWRETVEALDFAKSSRKAWRLLRLMGAAATPAYKPPQVSPDEIARQLINNSRTSIDKSTRRQVYKELYCTLDNCQETSEFSRPFSVEEVDAGIAQLKCGKASGLDDIYPEFIKNLGPRARKWLATFFTDIHSTSIVPKEWKEARIIAILKPGKDASDAQNYRPISLLSVCYKLMERLLLKRLMPTLEEIVPQEQAGFRTGRNCCDQVLALTSHIEAGFERQLKTATAFIDLSSAYDTVWRKGLLLKLAKAVPCRPTIRLITEMLSNRWFTVHLGEAASSPRRLNNGLPQGSVLAPALFNLYTSDIPATSCRKFTYADDIALATQARKMEDTEAVLEKDLKTLEEYFKNWRLKPNPSKSVVSAFHLNNRQASKTLNVNFCGAKLRHDEHPRYLGVTLDRTLNYHHHLKQAKGKTKARVNIIQKLAGTTWGSDASTLKISTQALVHSTAEYCAPVWGASPHTNLVDAEINNALRIISGSLKSTPLPWLPVLANIAPANIRRDDATTREYNKIMKNFTLPLHQDLKEPPRPRLKSRKPFWIRASALAAENKDTATRWSESWAAMDVANKNIIHDPTVEVPGFSLPRRLWTTLNRARTQHGRCAYTFHKWKIKESPNCDCGEVQTIKHITDECSIHAHPGGIAEIHTASTTSLDWMRNLCIHL

SEQ ID NO: 3077 - protein, 736 aa, synthetic construct
  source 1..736: note = Description of Artificial Sequence: Synthetic polypeptide
SLSHTSAAVSSPNSKQILFKASLSLISERIRLLRFELDTLDRTLLQAHLTLTQKMSPSDWNHVDNMTASSADSLSVKCKANLISKFNHLSKKNPVPHITKLDVNKIVINQSSTPISDNLKTVLARGLNFAVTPKHIPVDDIISQVDVALKGIGHIQADVARAEIATILKNAKKPISNISKNERSELANLKKQKKNRSDIVILSADKGNATVIMDKDSYNNKIQNLLNDGSYSKIKNDPTNSLTIKTNKIITSSTSLIEPTKRPSLKPSAARPPRFYGLPKIHKEGTPLRPIVSTINSPTYKLARFLSDTLLPFTGKTSSAVLNSAQLVSMVKDVVLSPDDILVSFDVVSLFTKVPVPDTIEIIENLVQHGLDPDTPALVRHCLTNTYFTWNGTFYKQNEGTPMGSPLSPVIANVFMEKFESDAIQTSTLRPSLWKRYVDDTFVIWPHGLPALNLFLHHINSRHPAIKFTMEVEKDGKLPFLDVLFERRPDGSLGHSVYRKPTHTDSYLKPDSHHHPAQNNSLIKTLYHRAHCISDQHHLTSELKHVHLALKRNGYSDRTIRQAVSPSIQKQPLDTPVKTITLPYIAGVTKKISKILNKHKILVRFNTVHKIRDLIPSVKDVIPDLQYPGVYKLSCTCGDCYIGETKRHVSDRIREHKSDLKHGRTNSSAVADHCYNAVGDHDIVFSDTKVLCKPTGFYQRFVHEAIQIYKHRHNFNREDGFKLSNHWKDVLNQTKH

SEQ ID NO: 3078 - protein, 776 aa, synthetic construct
  source 1..776: note = Description of Artificial Sequence: Synthetic polypeptide
KSKFHRLYGEGFHITIRSFNKLRDKKAHLIESLTFLKRCHNSKVIPISFTLTSAAVTSSNAKRILFRASLALISERIRLLRTELDHVDKTLLKSHLTLTEKMSTSDWEHVDNMAASSAATMSAKCKDNLISEFNLLSKKKPDPHIKKDVDKVVINLSNSPISDGLKSVLAKGLNFAVTPKHIPVDDIIAQVDVALKGLGHIAADVTRSEIAATLKSAKIPVSNISKDERFELSQLKKRDDIVILSADKGNATVIMDKTVYNDKIQDLLNDGSYTKIKRDPTNSLVTKTNSIITDSASLIEQTKRFSLKPSAARPPRLYGLPKIHKEGTPLRPIVSTIGSPTYKLARYLSETLQPFTGKTTSSVLNSAHLVSSIKDISLSPGDLLVSFDVVSLFTKVPVPDTIAIIEDLVQQGLNADVPALVRHCLTNTYFTWNGTFYKQTEGTPMGSPLSPVVANIFMENFETDAIQASTLRPSLWKRYVDDTFVIWPHGRPALNQFLNHINSIHPAIKFTMEVEKDGMLPFLDVLIKKRPDGSMSHSVYRKVTHTDAYLKPDSHHHPSQKNSLIKTLHHRAQCISDHEHLTSELKHVHQALKANGYSDYTIRKAITPTVRKEPSEDPIKTITLPYIAGVTKNISKIMNKHKIQVRFNTVHKIRDLIPSVKDKIPDMQYPGVYKLSCICGSSYIGETKRHVSDRVREHKADLKHGRTNTSAVADHYFNAAGSHEIDFSKTMVLCKPTGYQQRFVHEAIHIYRHNFNREDGYKLSNHWKDVINHFGS

SEQ ID NO: 3079 - protein, 1266 aa, synthetic construct
  source 1..1266: note = Description of Artificial Sequence: Synthetic polypeptide
MPAQDTTRRAVRATASSSTGHFPSFTRALSPSQASVVLGEQISFGTFDERCAAALAHCTLLDEVIATLPKLYQVALSPVLTDIHHDATKRVEIAAQLERLRQHKAAGTLPSPLKGLGSTPAIQFMKGFLESQKPDFPGKAPDIVKACAAKLLDGFIETKAAEHAWYESRLQAMEVTRRVLTAADTHWKDELEQRYQVLEGFVRPPVEGQVPATVPSAEELHPLKFVTDPVMVAQHENIRRSIPRLASTVIMLVVNRALTQQQRNKAKRDLKDQADVEMATDDTAVDSAVKRLEKQVEGLVSGMKALTNGKGKVSFSSSSRTHVEDAHPFVSGQSPSSRPFSLVDHRARHEAQGVQLGKRLRQRQDDGHQGPSRRLRCSSGEAGSPQEGQGEGTREGQEDPEEIVAYVRAAPWRYDAPHSYPDVILMLPAPRAIQLLLERVPLEVKRAARFRSRVFLGPHVTVPEHLQMHVSSSLRYLMYSVPSSNVVREAWEDFKDRFRWRVFFTEKLIDSPNDDDPDFDPDYVVPKARKRFDDGVRTTPAYIELGLRKGDKFVDDYISNVMPSVKATSRSLNLVWLDELKDYLSANKYIVSPSDKNLGVCILQADWATDQTRTLWNDPSNYRKLGSLLEADEIMEEKHERIFRAARLARRLGKRQLAEFLVSKIHGKDAKTAGYTLGQFYGVPKVHKRPVKMRPIVPCHSVSQAPSATYVSKMLKPLVSRQPHVIHGSKHLVRQLESLQLDKHRKAWIVSGDIVAFYPNIPLENCIRVVTQMWRNSPEAEKLSPEERQLFLMSFMTANKRLVIQFGDEYAEQIRGLAMGIACSPDLANLYGSHYENPILARPDMKSKFAFFGRYLDDVLGIVYASSAEEAMSYANEIRYDGVEIEWSVSEYHTPFLDLFLYLDPVEKRLHWKPYSKPLNHRERIPWASHHPKDVKKGTFIGEMSRLATLCSKLEHYRDAISDLSNLYLARGYPDDAVRSWVKAHFSQRWERRLGEPIVRDEVFVLKSHFNPAWSAFNVHGLSEVVVESWLSSLSKLDGANQSQDRTWHAAESTDGSELKIFRQTTLGQFQGEQSSLYPGESRPEGVAGRVGVANVAKPRVTYDPRDVMDVDELVALSEPSFSAHDLSVVWTDNALRVPKSLRIRYAMAELRLDADPQVNPALHVPLGVEDQVGDLGPASDAESVASGDDGTTNSKPYRICTAKKDSGIVQEDLDIRSVGFHDRAWLVSRKKIRNLGDIVNSWKKDIIQAALNSDSVPHMHVDEWQ

SEQ ID NO: 3080 - protein, 22 aa, Deltaretrovirus sp.
RTLVLGAWLQPDPVPSYALLYK

SEQ ID NO: 3081 - protein, 22 aa, Deltaretrovirus sp.
RTLALGTFQGRSSQAPFQALLP

SEQ ID NO: 3082 - protein, 22 aa, Deltaretrovirus sp.
HSLAIGAFLGTSAHQTLQAALP

SEQ ID NO: 3083 - protein, 1096 aa, synthetic construct
  source 1..1096: note = Description of Artificial Sequence: Synthetic polypeptide
  VARIANT 278: note = Any amino acid
MWGGHRENLEGRALAELIDSYNLCTLNDGSPTMIPRPGARAQPVDITLCSPDLMSELSWEVIQEPLGSDHLGILVKSFNGRQATSGARIRHPKAGGWNLSKADWEKYRMVLDLKFSTSESTSCTYDYLTQEIRSAALGSIPRFPQWLYLNPNRAIKPWWDDDCNRVKQESIIAYESYKRAPTLENYVNLNRKLAISRRTYKEKKRIMWYEFCNSLDRQTPSNVIWKRIRSLKKGYSPQVEVTDDGHWVEEFHKSLTPDYASQFIDLSNIPIGDEDLNXPFQLWELKYALKKGGSTSPGQDGIHYQMLQNLPFPALLSLLRIMNEMWVGGAMIESWRTHLIFPLLKPGKDPNSYQSYRPIALSSCVCKTYERMIKHRLDWWVEEYNKLAPHQLGFRRHRGTLDCLAAFVNEVHLNRTENKPLLAAFVDIHKAYDNVNIAILKDKMLVMQVPGRVIVNIINMLQQRQLIIRRGVLVTGPRTTGIGLPQGAVLSPLLFNIYTSDLRDWLVPEIRIVQFADDFTVYTGGKSEENLVEIMGQALHDLNAWCNHLGFRISGNKSSVTMFSRKRQNILAGTIQLGPFKVSQSPIVKVLGLYVDHKLTWRPHIKRIIQSCEKALNVLRYVAHVTYGTDPKIALLLYRNLILSKIDYGCGIYGDACQTSLSGLDKVQYKAIRICLGAMRSTPTNVLLVEAKIMPLHIRRELLLGKFLSKRLIKFKEVSLMRVSELSEVVRSHRFWLKKKTPLMCEMFRVTEKLYSGLEVLHASPRRSLHYEVSCKESPYVHLDLYDKVKEEWGDLTYLAFIARMREIIINPYLLFTDGSKSEQGVGCAVLDPQTGSFRLYKLPNNASIFTAEIVAIWNAVILAEQIQSNDIIVILSDSKSALQKIKRPGDVFDPIIIEIISHLINAMGRLHLVWLKGHAGIVDNEKVDVLAKRAILLGEHTPVLNLADFEGALRKRCYDAWQKLYDLEKEIKGKYYADLQPRIPNKPWFVEVLEGERQFYTTIMRLRFNHNLTNPHLHKIKLLDSPKCDCDSGEDGDIDHLLFRCSRYNRNRDKFLKELATHVRFPCSAKSILAIMNPDALRIIYKFIRENKIKI

SEQ ID NO: 3084 - protein, 849 aa, synthetic construct
  source 1..849: note = Description of Artificial Sequence: Synthetic polypeptide
MVSSFRVDHQLYSDHMPIITTLLIHDKQQIYNDNTLPLLPKLNWSKQNLQKYQQSISFYLNHIVYKYDTLDAEVNYLNDIIRSSAIGNNNKKGPKVWKADWFDVECDRARRKSFKQLRLFRRTNEVEDKHLYLKYNFDFKRLCKNKKQKYYVDCARRLYNVKSSKEFWQQVRAFQKRKPWVLGNVSPEQLFEYFCSLHNSSVTARLVFDVSHRVDAFLDKPFSFDELELVLSKSKENKAPGTDRICYEFYKFAPIVFLNRLLLLFNKIFETSKIPASFKESIIFPLYKKGNKNSASSYRGISFINVICKLYSGLILHRLNNWLESNNILKESQAGFRSNYSTIDNLFNLTNIIKIKLSKKKQKVYAFFVDLSSAFDSIDRFSLIYKLHRTGLSTKIVTSIKNLLSGTTASVMCRNGLSPNFGTNIGVKQGCLLSPTLFSIFINDLEECLGGGVVISDNCKIKLLAYADDVVLLASNPISLQLMINEMESYCYRWKLKINLQKSKIMIFRNGGRPANNEVWYLGTQKVEVVNEFKYLGIILTPTLSYTKHFQNKLSKAKMSLNTIWHHFMDNTSIPFSTKIRIFNSVNRSMMCYGAQVWGWQRFVEVERLFYFFIKKLFKSPKTTPSAFIHTETGIDPIYLYTFEMHFKYLVRVLQLPDNRYPKILCHEIIKSKILWFLEIKNLITKFNLPNDLNWQNIGNFTLWEANFNILIKSLQADMNNTFQLKLFNSGSHPLYKNLQYNLGDNPYLSDSHPFHLIRMIFKVRGDLLPLNYKFYKNRDLDCLMCASGEVEDLFHFLAVCPALSNMREQWFGSRTLPAQHVAAYLNGKDWEALAKYCLAALSRRALLT

SEQ ID NO: 3085 - protein, 735 aa, synthetic construct
  source 1..735: note = Description of Artificial Sequence: Synthetic polypeptide
LNNKVNVEDKSFSQTIVNDISSMESLDDYKHIINQDFTNKEVLQHIKLLKSGKASGTDMISNEMLKHGAPFIINSLTKMFTQVLNSGIMPLHWNSSLIIPIFKSGNPKDANNYRGIAISSCVSKLYTMMLNTRLTKYLQETNQIVDNQFGFKKNHRTTDNIYILKSLINKYVNCKLKKSGNYLFSCFIDFSKAFDSVWREGLLYKLLRLGVGGNFYKAIKAIYKNTKYSIKLSAGITPYFNSCRGVKQGCNLSPQLFNIFVNGICDDVKNFDPVDLNGLKLNCLLYADDLLLFSTTQEGLQKCIDAVQNYCDNWHLKVNINKSKIIIFNRLGKNLENKFQFYLDATKLQCVNYYNYLGIVFQTNGKFHNAMSRLQDKAQKALFKMYKMLWISEECYSVSLAKKLFNSIIKPTALYGADVWGGVMLNIYKGSGKNKCTVDNCNFETKLFSDKLIPEKLHIKFCKRVLGVHRKASNDPCRGELGQYPLILDICVSVMKYYQRLVCKKKTILSLMQPMKNPKLLCMTHGLTLYKNYKKNNSIIDAAYEESKTLVHDPWLNFIQKLLVITDLTNSDPHQNNFCDIFKEKLKCLYRMKWKNNLLNNCKLDFYRCAKENFEFEHYLEKIKNKNHRIAYTKFRTSAHFLPIESGRHKGILKENRLCNLHECNEVGDEKHYILYCNNCQIKEQRSRFLAALYIYAPKLEDFSMDELFPIIVSSNDFFILSIFAKFIFYILDMF

SEQ ID NO: 3086 - protein, 1147 aa, synthetic construct
  source 1..1147: note = Description of Artificial Sequence: Synthetic polypeptide
CINDSLLETFVSKHDIVCLLETWLDYTDSVSVPNGYLYFRVDRKKHKNARKASGGMIIFYKSKFRKGINKFISKYKESLWLKLDKHFFGLENDLYINSTYIPPIGSSYYNSSDLTGEDIFNIIAEESLHYSNHGNVCILGDLNSRTVNLNDTLDDINISDIDIPYTELMDNNRQSMDTMNNKYGQYLCDLCLTTDMIIANGRIVGDLMGKITCFQYNGVSQVDYCVVQKSFLPKINYLKINELSHISDHCSLSLAINTNYVNEHSIDISLTPYKKYNWNNSSKENFVTQLNSKDSVDKMNTFLDNHFNLEESDKAISDFNDIMHFTADKALKFTAIKSRKFSRKNKRKNKQKWFDNDLAHVRKCLKDISRLVDKFPFDQNLRMQRMSINKRYKKLVKLKKNKFKEKLLHDLMNLETKNPSEFWDIIKQIKEYNDLDTSKHPPSIASTEWTNYFSKLYNISTTDSNSVLDSEVTNFVDNMDHNATSNPDLDKEISIAEIIKAIKKTKVNKSSGPDSILNEMFKCYSPLLLACISKLFNHILSSGCFPVHWSTSYLVPIHKSGHIWDVNNYRGIALSSATSKIFNTIIHIRIQHFLDKNNFFQDTQFGFRKNHRTTDNVYILKSLINKYTNKVGKHYLYACFVDLRKAFDSVWREGLLFKLANAGVTGKIIHLIKSMYSNTKYAIKTNQGYCKPFMSSSGVKQGCNLSPLLFNIYINDLSESLVQTEPVRLHDMSFNCLLFADDIVILSNSGSGLQDSLNLFNDYCKKWKLTVNIKKTKVIIFNKRGRKINDIFFLGDEQIEVVSSYTYLGITFQNSGNFTVAVNNLVKKAQRALGVLKQTLLLNNIIASPINAIKLFRSSVMPILLYGSEIWAAFNFKPNITPELFIQKLFSDSSKIESIHIKFCKQLLGVHKRASNIAVRAELGSYPLITEICTQMYKFWLRVKNKECSNIVHCAYQSECTINSNSWANFVSKLLEITRLNETDHNANIFRNNLKRIYYEKIWLPTLSKKEHNKLRIYNKYKSDYEFEPYLNKINNLNHRVSVTKFRISAHKLPIEKLRYQKIPSEQRFCTLCSDQSVGDEMHALFDCKLDEIVKARSYFWNTLSLYNDNILKLPKEDMFVHIMGIKDSFIANSLGKFINTILQCNT

SEQ ID NO: 3087 - protein, 676 aa, synthetic construct
  source 1..676: note = Description of Artificial Sequence: Synthetic polypeptide
RGEGSNSKKERCIQENAKSGTEENKVRYKRLKKQAKKVVAKAMREENEKVLSELKENPNKVYKIVKAMKGDGRDVTGGRCMRGSDGKLNFSERDRSKVWKEHMEKIMNEENEWDQDVEADLVEGPVERVSREEVVKAIRDMKTGKAAGPSEVSAEMIFASGDIGIGVIMELCQRVLDGRGMPEEWEVSVVVPIFKGKGDAKSCGAYRGVKLLEHAMKIVERVIVNRIRKLVEVDEMQFGFMPGKGTIDAVFILRRMQEEYRAKGKKLYMCFVDLEKAFDRVPRKVMEWAMRKRGIPEAMVRAVMSLYEGAKTRVRVGSELSEEFEVKVGVHQGSVLSPLIFAVVIDVVTESAREGLMREMLYADDLVLMDDTMEGLREKFVKWKKAFESKGLKVNLGKTKVMVSGTEEKALVSKVDPCGMCGKRVKVNSVRCVKCGKWIHGRCAKIKRVTQRLARDFACGRCKNGVGRVVEQEEKLCDEVESVKEFTYLGDKVSVGGGCEAAVTARARFAWVKFRECGELLYGKRFPLEMKGIVYKSCVRSALLYGSETWCLSENELGILRRTERAMVRVMCGVKLMDRKITEDLMQMLGLKEAVDRLAKANGVRWYGHVLRREDGHVLRRALDLEVSGPRKRGRPKKTWKMQVEEESGKVGMRMRDALNRAKWREGVRAIATSLR

SEQ ID NO: 3088 - protein, 742 aa, synthetic construct
  source 1..742: note = Description of Artificial Sequence: Synthetic polypeptide
INKNKKNFFKNEMINKLETCDKTDQNEYWSLLKQLRCQQNSLNPDSTINSDEWLDHFSKLYNNNNNNADFKQSLKLLEDTKLSNHELNNVISYNEIKKAIKNLKNKKSTAEDSISNEMLKTKNSLLIPCIQKLFNFILESGTYPTSWKSTILVPIHKSGDRSNPSNYRAIAISSCLSKLFTGIMNCRLTNHLEKNKLMNEVQFGFRKNRRTSDAIFLLKTAVEKTLYGKKETGAKCKRLYSCFVDLKKAFDSVSRDALFLKLQKTGINGNFYNIIKSMYTDQEYKVKLNSGITKGFHPTSGVKQGCNISPTLFNIFMNDLPGIFGENVDKPIMIDTFPLNCIQYADDLAIISESVDGLQNCLNKLNDYCTKWYLNVNVRKTKVMIFNNSNRLIKNMNFKINNEEITSVKEFCYLGTIFTPNGKFKINQSNLKNKAMKALFSIRHTILNHKMISTKLSLKLFDQLISPILLYGSEIWANEITNENNYLEQACNHFYRFILGVSKVTPLIGIRGEIGRIPIRIKATLSLIKYWHRLSLLPENHILKSALKETVSSNSSWIKHVKTILGHTDLSEVNKIYKVGNIAELTKLLEEKLKNKYIQTWYQQLSHVPKNGKSGNKLRTYNLFKMEYEFEGYLTEIQDFNLRRMVTKFRLSDHNLEIELGRRKFPRMEANYRLCKKCNTGTVEDEKHFILDCCFFTQERNTLLEDCKLEMCSTTNRNLIFTCIINSSTALAKYLKNTIYKT

SEQ ID NO: 3089 - protein, 1047 aa, synthetic construct
  source 1..1047: note = Description of Artificial Sequence: Synthetic polypeptide
  VARIANT 219: note = Any amino acid
  VARIANT 939: note = Any amino acid
IFIYVCLYPPENSVIHNRQDIDIFEKLSQDVIKYSNIGEVLLMGDFNARTGTLADHIINDNSTYMPIPDNYVDDEYNNRNNKDQKVNSFGKKLLELNKNNNLLILNGRTPGDLLGKFTCYNFAGGASTVDYALVSKSFLSNIQYFRVNEINNLSDHCAISLAITTRDLLSSDNNEIKCTPLPDRYLWDTKSIKRYQDALHSTEIINKLVSFNYENNNIXNSVTELTNIICNAADNSLKKIKHKISSSNKMKNTKRQKWFDDDCWNLRKKFREAAKLVEKYPKDCHIRGQFMVLRKKYNKILKIKRKQYKQNLWDSVTSQESNPKQYWKNFKIFSKNDTSISANNDIIQADEWYNHFKNLNNLKNSKTCKYDSDFQNKIINETREMETNKEINKELNEPITIGEVKAAVKKLKLNKSSGEDKIINELIKYGQNYLMEPITAVFNNVLKSGTFPKGWKGSIIVPIHKKGSRSDPDNFRGVALSSCLGKLFTATLNNRLIKYLEKNNLYSPYQFGFRRNRRTTDCLFILKSIVDKYIHSEYSKNSKSKKLYACFVDYKKAFDSMWRDGLYWKLQKYGITGNIYNLIKNMYSGVSYKVKTSKGLTNEFDSFMGVKQGCNISPTLFSLFINDLPEKIKSANGTPPELNSQKLNCILFADDVLILSQTQEGMQCSIDALAKYSNSWKLSVSLNKTKLMVFNKRNHTLNKKSVFYEGNEIATVDSFNYLGIVFTPNGKFKTASNTLKEKAMKAMFPLKQSLLTLSHYKISTALNLFDKLIVPIINYGCEVWGEESAKHSNIIESVQFAFCRFLLGVSKNSTKNAILGELGRYPLNVKIETQMLKYWLRLKSPVIPNIVATAFMEINTWKTGWVERIEEITKNNNLSELSKQHEKKIGEVLRENYVKTWRRELFNDSRMNGATNKLTSYRKFKTTFNMENYLNDIKXLKLRRLFCKFRISDHKLLIETGRQKKIPRNERICKLCTDDKIEDEYHFLIGCSKYDIPRNKLFKYIQGKKSDFLKMNEDEKFRLIMTSFAGIETAQFIHTSMNLRDET

SEQ ID NO: 3090 - protein, 702 aa, synthetic construct
  source 1..702: note = Description of Artificial Sequence: Synthetic polypeptide
  VARIANT 10: note = Any amino acid
TDSQDINTNXKHESNILNKLSTDSKELNEPISQLEIQKAINNLKNGKSPGKDNISNEMIKAGRHTLIIPVQKLFNMILTSGFFPTNWNTGIITPVFKKGDKSDPSNYRGITLLNTLSKLFTAVLKQRLIKYIDVNNLIVKEQIGFIPKFRTSDHIFVLKQILAKYLEKGKKVFACFIDFKKAFDSVWHQGLFHKLAQNGITGKFYTIIRSMYSESLSCVKTKNGLTSEFPVKRGIRQGDGLSPLLFNIYVNDIKNEIEQSNNDPPPPSLTVSQLSCMLYADDLLLLSVSESGLQNALNSLGTYCKKWKLEINTTKSKIMIFNKMGKHIKKHKFCIDKQELENVPTYSYLGIKLSASGKFYKAQEDLANRAMKACFKLKQQLFSETNIPIKIYLKMFDSVIKPVLLYCCEIWSNENINIKNLSNFNLPMEKLHSKFCKFLLKVNCKASNIACLLELGRYPLAFSSIVQTIKYWLRISDKPCNTLIYEAFRLGKDMDSKGIKNWVSHAKNIFNITNMDHMLDTVTADKKQTIITSLESNLKSMFKNHFKETLYNDNKGKNRKNKLRTYRMIKHNFDFEKYLEDVKNPSHRSALTKLRISAHTLQIEAGRYINQTVEERKCHYCQEKQIEDESHFLLKCSLYADLRNKFLHTTKVITTIDKSDIENTVDILKTKDKQSLIHLAKYIFECFNLRNDTHKQKIPAAL

SEQ ID NO: 3091 - protein, 1091 aa, synthetic construct
  source 1..1091: note = Description of Artificial Sequence: Synthetic polypeptide
  VARIANT 4: note = Any amino acid
LYNXYLISIIDKGHRDILGVRFENKLTGFTFLVFSCYLPPENSPWGRDANAFFSHLLSQLYMTDDVDTIIICGDLNARLGNLNDNIDVVDNIRNRHVIDTKINQHGHSFCEFLQESKLCILNGRFDRHQNDFTFISSRGRSVVDYVCVPQDHLSYCNNFNVITMSSLVEKYNLYDALTDRSKLPDHSLLIFDFLDRPLGSIVEQSLPNDINIGNNRHSATVRKYCLNQTPINFLESEVAREALLHIISKIEICRETQQEIDEIYDDLCKCILNEMNSTIPNYNCSSGARKRFRHHKPYWNDELYSMWRVMRERERSYTRFGGSKNIRTILRNDFKAARRAFDKKLRCCERNYRNDLVSSIEKVCTENPHQFWEHINKLGPVKRKDIPMEVYDDGGHITSNHNIVLNKWKHDFSSLYNQSDLDGFDANFYEHILHHKLVLENDLDDPLYDSNSELNKNFSTVEIKTVVAKAKSGKAVGVDKIPYEVLKNDSSVAILTHLFQLCFDSAKVPCIWKKALICPILKVRSSDPRVPMNYRGISIQSTLSKLYSALLNNRITRFLENNNILVDEQNGFRKDRNCEDHIYILTSIIRNRISHDLSTFAAFIDLRKAFDSVDRDALLYKLLINGINGKMYKSIRAMYSDTNSSVKLNDFKTDWFNTEQGVRQGDNLSPTLFSIFINDLAVEINLKQKGITLDNNVNVSILLYADDIVLLADNEIDMQMMLSHLNSWCEKWKIRVNNVKSKMLHFRKASEARSAFQFCIGDDVLDYTDKYRYLGIVLDEFVDYSVTAGIAADSASRALGALFVKFKTLKNLGFSTFTKLYDASVAPILDYCSGVWGFSKFEKCEMIQNRALRFFLGTHRFSPLPAVKGDTGWVSCRDRRWAHMVRLWKRLTELDDNRLVKRVFLWDHSLNYNNWSSEIYQIMELVDLNYEHLIDVNIHALRENIARRSESSWSEDVSHKPKLRVYATFKFEYKPEKYVLINLSRGQRSLLAQLRMGILPLRIETGRFRHEPVSERICKFCDANVVEDEMHFLFDCQQYNELRHEYLDSILNEITGISREQILVRLFSGPIRKLALFIEKAFYKRRNLLYV

SEQ ID NO: 3092 - protein, 1083 aa, synthetic construct
  source 1..1083: note = Description of Artificial Sequence: Synthetic polypeptide
MTPACFVDYKLSLPNRGTDYVCSHTRDSDSLLVTQTFGLPSYSNHLSPALYSCYLMKLLYNMILLPSDAHSDVINQHCRALPVLCRALIVLLLMISGNVHVHPGPSTVASPNSDLCSDICFTDFCSRKSLGFLHVNTRSLLPKMDQLKVWVHSSNPDVLVITETWLRKSVLNTDVNLSGYNLFRQDRSSKGGGVAIFTKDHLQCSVVSTKSVPKQFDLLVLSIKLSNSSLLTVAGCYRPPSAPACTLPALSSLLAPYTKSEFVLLGDLNWDMLKPPDQVLKQWDSLNLSQIITNPTRYDSKHPEKATLLDVILTNNPDRYQSGVFCNDLSDHCFTACVRNGCSVKRPVLICHRRLLKNFNEQAFLHELASVKWYRISLIPSVEDAWTFFFDIFSGIVNKHAPIKKMRIKNRFSPWFDRDLAELLHLKNCIWRKARHTHTQADWLSFRQMRNKCTQAIRKAKVSYFKEQFSLCGSNPKKFWKTVKDLENKPSSSQLPMSLNVDDVVVTDKKHMAELFNHHFIKSGFLFDSAMPPCPSNISSSPTPSNATIPDASPSFSPAPLQSFSLQAVTESEVLKELLKLDPKKTSGSDGLDPFFFKVAAPIIAKPISNLFNLSLLSGEVPIAWKAATVRPLFKGGDQADPNCYRPISILPCLSKVLEKLVNNQLTGFLDVYSILSGMQSGFRSGYGCVTATLKVLNDVTIALDSKQCCAAIFIDLAKAFDTVDHSILVGRLRSIGVSEGSLAWFANYLSQRVQCIKSENLLSQPLPVTKGVPQGSILGPTLFSIYINNIAQAVGSSLIHLYADDTVLYSAGPSLDFVLNALQQSFLSVQQAFSTLNLVLNTSKTKVMWFGKKNAPLPTGVITTSEGLELEVVTSYKYLGVWLDGALSFSQHISKLQAKVKSRLGFLYRNRSSFTPAAKLTLIQMTILPMLDYGDIIYRSAGKGALERLDVLYHSAIRFATNAPYRTHHCTLYSSVNWSSLYTRRKTHWLMLIYKTLLGLTPPYLRYLLQPSSSTYNTRSASHILLKVPKAHTSLGRSSFQFAAASDWNELQQTLKLDSFISISSFKDSIMDTLTDSCGCFV

SEQ ID NO: 3093 - protein, 1208 aa, synthetic construct
  source 1..1208: note = Description of Artificial Sequence: Synthetic polypeptide
  VARIANT 349: note = Any amino acid
QRNSKGVMVLINSNFDPNVQIVQTDHQGRWIILNMLLDNKQIWLINLYGPNNDDPSFFENIYKNLSTLQATLDSIIMVGDFNTVLNTSMDRKGNHTTNYHPQALKEIMNVMDILELVDIWRLKYPDLVRYTWRRLNQASRLDYFLMPFSLAPKVKVLIGDRMRSDHHIIGIYITLTEFPRGRGYWKFNQSLLDDKLFRTRTEEFITDFFRHNIGTADPLIVWDTFKCAFRGHAIQYSSIKQKQFRSKESILTKEIEGLTVQLDSNKNGTIEAQNKLEEKQKEMEELIQERSSVIYYKNKANWMEYGEKCTKFFFNLQYRNATKKMYKCYQKNVLKLVTNDGVTHDSPNXILKEEVKYFKNMFSFQAPPSPLTETNCMDFFPNNNVKLTSVQKDSCEGQITEEELLDAIGAFKDGKTPGLDGIPVEVYKTFFDILKGPLLACFNHSYINGRLSDTQQEGLISLLLKQDPSGIYKDPVHLKNWRPLTLQCCDAKILAKCLAHRIKKVLSDIIHPNQTGFLHGRYIGDNIRQVLETIEYYEISGTPGLVFIADFEKAFDKVRLEFIYKCLEYFNFGESLIKWVKVMYSNPRCKIVNNGYISESFKLSRGVKQGCPLSAYLFIIAIEMLAVKIRSNNNIKGLEIRGLKTKVSLYADDSCFLLKPQLESLHGLIEDLDTFAILSGLKPNYDKCTILRIGSQKNANFTLPCSLPIKWSDGDVDILGIQIPKERNDLTPIHFYRKLAKIDKILLPWKGKYLSICGKITLINSLVISQFTYLLMVLPTPSDLLFKLYEQKIFNFIWNGKPDKIKRAYLYNEYEFGGQKLNIKALDLSLKASVIPKLYLNPNWFSSKLVRMSHPMFKKGLFPFIQITPAHFRLFEKEIISKISLFFKQALESWLQFQFNPPEKTEQIIQQILWLNSNIVIDKKKIFEEMFKKGIILVNDIINRTGGVMSHMQLTQTYGNVCSTQNYNQLIAALPQKWKRQVEGEKSKELVCRPCIKEHKWLKKSVINKNIYQFHLRTKKLTAVPYKLQNSWEEIFDVPIPWHMVYELIRKTTPDSKLQIFQFKLLYKILATNRMLYIWGIQSSQLCRFCCEEAESLDHLFWYCPYVARFWSQVQEWLKNCNICLELTLQIAILGDLKSHSQSINNIIIILAKMFIFNLQSVEAMRIERFNCFVKHHSTVEKYMANRNPKWMMLRDRWEGLNGAEGWD

SEQ ID NO: 3094 - protein, 1279 aa, synthetic construct
  source 1..1279: note = Description of Artificial Sequence: Synthetic polypeptide
  VARIANT 407: note = Any amino acid
MVRGEISIASYNCNGLADYKKRRSVFTWLKEKEYNIYCLQETHSTSLDEVAWKKEWGGEIIFCHGQRNSKGVMILINKNFDLNVQIIRNDSQGRWILLNMKVDEKEIWLINLYGPNQDDPHFFENIYTNLLNLQATNDLIIMVGDYNTVLSTSMDRKGNHSTNYHHRALKEITNIMDTLEIVDIWRLKNPDLVRYTWRRLNQASRLDYFLVSFSLASKVKKVLIGDRMRSDHHLIGIHITLIDFPRGRGYWKFNQSLLEDNLFLTKTKFITEFFQYNIGSANPLIVWDTFKCTFRGHSIQYSSIIKKQFLAKETRLTREIHELIVQVDSNKNDTTEIQNKLEEKQKELEELIQERSNVIYYKNKANWMEYGEKCTKFFLNLQYRNANKKNLQKLVTEDGVIYDSPNXILKEEANYFRQMFSFPSHPLPLNEDYGKEFFPNNIKNGKLTNVQKDQCEGQITEEELFEAIKSFQSGKTPGLDGIPVEVYQVFFDILKAPLLDCFNYSYRNGSLSGTQQEGLISLLLKQDPDGKYKDPVYLKNWRPLTLQCCDAKILAKCIALRIKRVLPGIVHPDQTGFLHGRYIGDNIRQLLEIIEHHETYKKPGMVFIADFEKAFDKVRLDFIYKCLDFFNFGNSLIKWVKIMYSNPRCKIVNNGYFSESFELSRGVKQGCPLSPYLFVMAIEMLAIKIRSNNNIRGLEIQGLKTKVSMYADDSSFMLSPQARSLQCLIKDLDNFSVLSGLKPNYDKCTILRIGSLKNTTFTLPCSLPIKWADGEVDILGIHITKDINKLSTMNFNRKLVKIDKILQPWRGKYLSIYGKIALINSLVISQFTHLLMALPTPDDSFFKSYEQKIFRFIWDAKPDKIKHAYLYNEYELGGLRLLNIKALNLSLKASLIQKFYLNPKWFSSRLIRKAHPLFKNGLFAFVQIAMSHFRLIENYTFFKVSVFFKQALQSWLQFQFHPPEKIEQILWLNSNVLVDKIPVFMGKMFEKGILFLNDIVNWNGRVMSFMELSELYGKVCSIQEYNQLITALPQKWRRRVAAGGGRELVCLPNIKDQNWRRNKNSINRKVYQFHLRTRMLTTVPYRLQNSWEEIFDVPIPWYRVYELIYKTTQDSRLRAFQLKLLYRILATNKMLNIWGIKSSKLCRFCCEDTESIDHLFWYCPQVACFWSQVQEWLKMHSIDLKLTLEIVLLGDLERPGQSITNILILLVKVFIFNSQSVDSIRLDRLKLYVKHHSIVERYVLRRNPKWVASRDRWDGLREAEGWYVELETSGSGVAV

SEQ ID NO: 3095 - protein, 1281 aa, synthetic construct
  source 1..1281: note = Description of Artificial Sequence: Synthetic polypeptide
  VARIANT 743: note = Any amino acid
WFGALSYLFSDLHAMQATIGTTNERRAGLTFTSWNVKGLNEPIKRGKVLAHLKALSSDIIFLQETHLKNNSHNRLKCKWVGQVYHSNFSAKTRGTAILVRKGIPFLHKTTIVDKEGRYVIVIGEIHSTSVTLLNIYGPNIDNPSFFKRVLALIPDISHTNLVIGGDLNCVLDQYLDRSSTRRTPTSYSSEFLNTYIKNSNLFDIWRISNPTGREYSFYSHVHNVYTRIDYFLVDAKLLPYTCNVRYHDIIISDHSPLTFSLRLGDIVPNERVWRLNPQLLTEPTFCEHLKDQITFFFDTNDNTETSPALLWETLKAYLRGCIISFQTARSRQNRGELVELEGQIHLLDRENASHPSMEKHKKITSLKFEYNQILSAKIAKSFLYAKQKYFEFGDKPHKLLARQLRKNVSDRMIHKVKSASGELLSSPKDINDRFRQFYETLYTSKADPNPLIMQNFLEDCNLPALNQEDSNFLNKEISLEEIRETIKSLKSGKTPGPDGYPGEFYKTFSNMLSPYLHKMLVQANEDGALPSTLDEAFITVIHKKGKDPEEVGSYRPISLLNTDQKILAKTLANRLSTLIGKLVHSDQTGFIPNRNSFFNLRRLFNIMYSQRLPNVDLAVISLDAEKAFDQVEWPYLFKVLQKCNIGDGFIKWIQLLYRNPCARILTNQSLSPRFNLYRGTRQGCALSPMLFALIIEPLAQAIRSHAAIHGYNTKDTLNKISLYADDILLYVTEPQDSIPAILXVINLFGTFSGYRINWNKSELMPIRLQNTSWLEHLPVKLSSEKFTYLGIVVTKQYSLLFKENFPSLMQKLKANIQFWRTLPISLLGRINAIKMVFLPQLLYLYQNIPVFIPKSFHKQLDSIINPFIWDYKTHRIGKKHLCKSKMEGGLSLPNFIFYYWAANLRAVTFLLDDAPPPSSWLSMEREECHPFSIGAVILSPVNLEMSLYRNNPIIHSTVRIWKQIKVHFELRPISFMLPVARNPSFAPSNLDNTFERWGELGISTIGDLYIGGTFASFESLRETYNLPRSNFFRYLQIRDYVRKHLPTFGNAKPSMFDGCIKICPTSDKLISRIYDAFQSVSAPSTDAIKAKWEEELGTDISVADWEDSLEYIHTCSINSRHRLIQFKVLHRLHYSKTKLHRIFPGTSPMCDKCQAEQGTLLHCFALCSNLYGYWCGIFGVLSEVLETSIDPDPLLIILGVSDSLNGLTNPQKQLISYSLISAKKLILLFWKKREAPSTKLWLSELANTVHLERIRYILNNKLSTFDQIWQPFLSYLDQAAL

SEQ ID NO: 3096 - protein, 1185 aa, synthetic construct
  source 1..1185: note = Description of Artificial Sequence: Synthetic polypeptide
  VARIANT 5: note = Any amino acid
  VARIANT 6: note = Any amino acid
  VARIANT 7: note = Any amino acid
  VARIANT 141: note = Any amino acid
MSLRXXXYFAMIVSYVAALLIISVRPCWDDTINLLPENIYTKHIGSPIHRSGLYTAYHNVLNNGQVYLAPYSTEPLRRDKHKSNIYRKLLNYLFTTLLLSGDVQLNPGPNITEPAILTGVESRGWPRPLIVAAVEVGECYXPMVSLDSPGSRIDFDSSNIPKPLYAIPDFASGTQAVLISSPHPVQAGGIVNSATELPLIKTKQNGLNPAVRKHRKCNFFQCVNHSRVIWDPRAKPKGLLGGHLNIRSVIPKSDQIQHLLTDSNLDFLCLSETWLHKNSPCAALIVPGYNVFRRDRIEGRGGGLMIYIKEHIRCKQIEWSCDNELECIGLNVTLSPQMSFTLIGMYRPPSTKSVFFDQFNNMLRECDFGKEVILMGDFNINYEDKSCRKTLKRITNTFDLTQLVKGPTRVTCCSKTQIDLVFSNKPERVTKSFNMVTGLSDHNLTLIARKLSKSRFKLSTVRKPDQLRIPKSELNYFENAINGINWNDLLSYTDVEADSEVFLSTIQATINGFLKKIKSKPGQKSTLPWLNGEIWKLMKERDYALKTALKSKLEHDRRRFTMLRNKVMKEIRQAKANFFINIIGEAKGNSKLIWENLKKLTGKDHSNTAKRLEIMVNNNLTQDAVEIAIAFNSYFIDSVRVLTQNPSTGLLGSVLVNDAQPVFIIREVSESKVNKVISSLKNSKSKDVFGLDSTFLKNYKESLIGPITKVTNTSIGLGVFPRVWKSAIITAIFKSGDPADVSNYRPISILPVVSKVVEKCVAEQLISHLNNSPFTLHSMQFGFRAKHSTETANCFLLENVKSKMDKGGVVGAVFLDLRKAFDTVNHEILITKLSKFNFSPDALRWMKSYLEGRTQCVRVSNELSPTLSYDVGVPQGSILGPLLFSLYINDLPSVCTGSEVQMYADDTVIYVHAKSKQQAAQELTTVMVQVTKWLSDSCLHLNVKKTVCMFFTKRATDATEPDVYVSGEKLQVVSDFKYLGIILDSNLSFKKHVKKVIQITKFNLANFRFIRNCLTTEVAKLYFKSMILPHLTYCLTSWAQACYTTLKPIQSVYKQALKVLDRKPNSHHHCYILRKHELLSWENLVQYTDACLVFKILNGLAPPPLSIFVKQKTQTYGSRSTRSAMRGDCIVPLRKSTFSKSAFSVRASHVWNTLPSDTHNCTTYHTFTKCMKTWLKVNQTCEHNP

SEQ ID NO: 3097 - protein, 998 aa, synthetic construct
  source 1..998: note = Description of Artificial Sequence: Synthetic polypeptide
LLDIRAAVTHQHYDQEYDFPELDPLFVPPRAIELIPEAAPRRRRRRRGIRSGLLVRLRRRAHHPPLPSILLANVQSLDNKVDELRARISFQRDIRDCNILCFTESWLSPDILSPSIQPAGFSVHRADRNKELSGKKKGGGVCFMINYSWCDCDNVQKLKSFCSPDLEYLTIKCRPYYLPREFSSVIVTAVYIPPQADTTTALKELHWTLCKLETTYPEAAFIVAGDFNKANLRKTLPKFYQHIDCSTRAAKTLDHCYSPFRDAYKALPRPPFGKSDHDSILLLPSYRQKLKQEVPVLRSIQRWSDQSESMLQDCFDHADWDMFRVASENNIDVYTDTVTEFIRKCIGDVVPTVTIKTYPNQKPWIDGSIRAKLKARTTAFNHGKVTGNMVEYKQCSYSLRKAIKQAKRQYRDKVESQFNGSDTRRMWQGLQTITDYKGKTSHVADTDVLLPDKLNTFFARFEDNTVPPTRPAPKDCGLSFSVADVSKTFKRVNPRKAAGPDGIPSRVLRACADQLAGVFTDIFNLSLSQSAVPTCFKMSTIVPVPKKAKVTELNDYRPVALTSVIMKCFERLVKDHITSTLPDTLDPLQFAYRPNRSTDDAIAIALHTALSHLDKRNTYVRMLFIDYSSAFNTIVPSKLIIKLGALGLNPALCNWVLDFLTGRPQVVKVGNNTSTSLILNTGAPQGCVLSPLLYSLFTHDCVATHASNSIIKFADDTTVVGLITNNDETAYREEVRALAEWCQENNLSLQRQQNEGADRGLQETAEGARPYPHRRDRSGEGGKLQVPRRTHHGPWRSGARKITSPSNVNKTKELIVDFRKQQREHAPIHIDGTAVEKVESFKFLGVHITDDLKWSTHTDSVVKKAQQRLFNLRRLKKFGLAPKTLTNFYRCTIESILSGCITAWYGNCTARNRRALQRVVRSAQRITGGTLPALQDTYSTRCHRKAKKIIKDINHPSHGLFTPLSSRRRGQYRCIKAGTERLKNSFYLKAIRLLNSHH

SEQ ID NO: 3098 - protein, 1043 aa, synthetic construct
  source 1..1043: note = Description of Artificial Sequence: Synthetic polypeptide
  VARIANT 45: note = Any amino acid
  VARIANT 327: note = Any amino acid
CFCHRILRQKRASGYQDSDHSPRIRQRFFLQQQQAGLTGYSPNTXQGRHPRYSQEEATRRGRRAGCLVRTRRRRVGKLPLPSVLLANVQSLDNKLDEVRSRISYQRDIKNCNILCFTESWLNDDMDIQLAGYTLHRQDRTAHSGKTRGGGLCIFVNNSWCTKSKEVSRFCSPEVEYIVINCRPHYLPREFSAILFVAVYLPPQTDAGTKTALSQLYKDISKQENAHPEAALLVAGDFNAGKLKSVLPNFYQHVKCATRGKKILDHLYSTHRDAYKALPRPPFGKSDHNSILLIPAYKQKLKQEAPVTRSIRKWSDEADAKLQDCFAXTDWNMFRDSSDGIEEYTTSVTGFINKCIEDVVPTVTVRTYPNQKPWITGNIRTELKGRAAAFKERDSNPEAYKKSRYALRRTIKQAKRQYRAKIESYYTGSDARRMWQGLQTITDYKGKHSRELPSDTSLPDELNHFYARFEASNTEACMRAPAVPDDCVITLSVADVSKTFKQVNIHKAAGPDGLPGRVLRACADQLAGVFTDIFNMSLTESVIPTCFKQTTIVPVPKNTKATCLNDYRPVALTSVAMKCFERLVMAHINTIIPETLDPLQFAYRPNRSTDDAISIALHTALSHLDKRNTYVRMLFIDYSSAFNTIVPSKLITKLRTLGLNTSLCNWILDFLTGRPQVVRVGSNTSATLILNTGAPQGCVLSPLLYSLFTHDCMARHDSNTIIKFADDTTVVGLITDNDETAYREEVRDLAVWCQDNNLSLNVTKTKEMIVDYRKRRAEHAPILIDGAVVEQVESFKFLGVHITNKLSWSKHTKTVVKRARQSLFPLRRLKRFGMGPEILKRFYSCTIESILTGCITAWYGNCSASDRKALQRVVRTAQYITGAKLPAIQDLYTRRCQRKALKIVKDPSHPSHRLFSLLPHGKRYRSAKSRTKRLLNSFYPQAIRLLNRDQKAPQQLLPPSHKTPEQVIKWLPGLFALCAPPPSSTLCLSYMHSHFNYTFMYILPQLARPTSAPAHWLTGLSALCPTTRQPLFLRCCYSLFIIYA

SEQ ID NO: 3099 - protein, 1015 aa, synthetic construct
  source 1..1015: note = Description of Artificial Sequence: Synthetic polypeptide
  VARIANT 388: note = Any amino acid
  VARIANT 425: note = Any amino acid
MFFSLALFALFHIMSISGKLPRKGLKIAHINICSLRNKVHEINNLLTSDNIHILAISETHLDNSFDDTSVAIQGYNIYRRDRNAYGGGVAVYIQSHIPVMLREDLMSSVIEVLWLQVHLAHLKPFLLGCCYRPPSANSQYLNNMCEMLDSVCDVNREVYFLGDLNIDWFSSSCPLKRKLLTVTSACNLVQVINQPTRVFTNTTGTRSSTCIDHIFTNAVELCSKAVSVPIGCSDHNIVAISRKAKVPTAGPKIVYKRSYKRFCCDSYVDDVKNICWSDVINEEHPDAALDEFMKLLLPIIDKHAPVKKLTVRTVKAPWIDEELKNCMVERDGAKGVANKSGCTSDWLTYCKLRNYVTKLNKKKKKLYYEAKINDIKNDGKKTLEYFKXNYGQKDKFNSIFHRIRWLIHHKTIRMMEKKLWSTLNXIMGRKTNSTPSFIESDGLFITKPFDVANYFNDYFIGKVGKLRQEMPTTNSEQLYSCIKKQIMKEKQCKFEFCKVSVGEVEKLLLSINNDKPPGIDNLDGKLLRMVADSIATPICHIFNLSLEESLCPQAWREAKVIPLPKSGKAAFTGSNSRPISLLPALSKLLEKIVFDQIQCYFSVNKLTTDFQHAYREGHSTCTALTQMTDDWLKEIDNKKIVGAVLLDFSAAFDIIDHNLLLKKRMCYGFSTSAISWIQSYLSNRTQRVFFNGSFSNVKHVKCGVPQGSSLGPLLFSIFTNDLPLALNKACVSMYADDSTIYASATTANEVTETLNKELQSVLEWVASNKLVLNISKTKSIVFGTNHSLSSRPQLNLVMNGVAVEQVEETKLLGVTLDCKLSWSKHIDSMVVKMGRGLAVIKRCSAFLTPHSKKQVLQALVLSNLDYCPVVWSSAARKDLVKLQLAQNRAARFALNCNQRADINTMHASLSWLRVEERLTASLLLFIRNINVLKIPNCLHSQLTHSSDTHTYPTRHATRGLFTVPKSRTNSRKRTVLYRALIAWNFLPSHIAQINSKPGFKKQIKQHLAAQRLSPI

SEQ ID NO: 3100 - protein, 770 aa, synthetic construct
  source 1..770: note = Description of Artificial Sequence: Synthetic polypeptide
MISCRPHYLPREFSSVFFVAVYIPPQSEAGTKTALNELYSAISKQENAHPEAALLVAGDFNAGKLKSVLPNFYQHVKCATRGKKTLDHLYSTHRDAYKALPRPPFGKSDHNSILLIPAYKQKLKQEAPVTRSIKKWSDEADAKLQDCFASTDWNMFRDSSDGIEEYTTSVIGFINKCIDDVVPTVTVRTYPNQKPWITGNIRTELKARAAAFKERDSNPEAYKKSRYALRRTIKQAKRQYRTKIESYYTGSDARRMWQGLQTITDYKGKHSRELPSDTSLPDELNYFYARFEANNTETCMRAPAVPEDCVITLSAADVSKTFKQVNIHKAAGPDGLPGRVLRACADQLASVFTDIFNLSLSESVIPTCFKQTTIVPVPKNTKVTCLNDYRPVALTSVAMKCFERLVMAHINTIIPGTLDPLQFAYRPNRSTDDAISIALHTALSHLDKRNTYVRMLFIDYSSAFNTIVPSKLITKLRTLGLNTSLCNWILDFLTGRPQVVRVGNNTSATLTLNTGAPQGCVLSPLLYSLFTHDCMARHDSNTIIKFADDTTVVGLITDNDETAYREEVRDLAVWCQDNNLSLNVIKTKEMIVDYRKKRTEHAPILIDGAAVEQVESFKFLGVHITNKLTWSKHTKTVVKRARQNLFPLRRLKRFGMGPQILKRFYSCTIESILTGCITAWYGNCSASDRKALQRVVRTAQYITGAKLPAIQDLYTRRCQRKALKIVKDSSHPSHRLFSLLPHGKRYRSAKSRSKRLLNSFYPQAIRLLNI

SEQ ID NO: 3101 - protein, 1090 aa, synthetic construct
  source 1..1090: note = Description of Artificial Sequence: Synthetic polypeptide
MYLLLCLLFTQCHPGLNRLNDQWVSELSSPYALQFANTPTRPSCQYHQELGLSLQLHLYHSQTQLDLHLMAYFQNLKLLNYFFSVSKDSVRFIDNGAGSTKSSRIGQLRYIVMLLLLISGNVRPNPGPVDTMQSLPTPYDFKNRAGFGLLHVNVRSLFPKIDMIRIWAKTTNADVMVLSETWLKKSVSNNSISIDGYTVFRTDRMSKGGGVAIYVKSEFNTSEILSITKAKHFELLAVKVNVYKDSHITVVGCYRPPSASGDALNSLSDVLHKLNDSEFIILGDLNWDMLTSVSDSFKELCDSLNLAQLINAPTRPNPRAPNKSTLLDIILTNTPHKYTSTGIFCNDVSDHCAIACVRNTKMTKAKPRYIFKRHFRQFDEQAFLHDLYHNIDRVSLIPDVDTAWDYFYMKFVSICDKHAPVKKFRISGRDNPWFSDNLAELIRKRNISWAQARHTNAPVDWASFRALRNKCTGLIRKSKSDYYLNAVTENLNNPTKFWKLIKSVSGSNVSSGLPDHLMMDSNEVKDKAHIVGVFNKHFISAGSVFDNGGAQASNVSSVTVNYDIGPHVNHFNFEPVSYTEVYKALKAIDTKKSAGPDNLDPYLLKIAAGIITEPVAHIFNLSLLTNSIPSIWKSAYVLPLLKGGDPSDANNYRPISKLPILAKVYESLVNSQLKNFFIEKNILSGVQSGFRSGHSTTTAAMAVANDIINALDKKQHCAALFVDLSKAFDSVDHELLLARLRNIGLSEGAVNWFRNYLSDRTQCVYTDNHKSSFLEINRGVPQGSILAPVLFSIFINDLGNGMQPAKLHLYADDTVIYSCAPSLVQAVEELQTAFQSLQASLYGLKLVLNVQKTKFMTFTRARTLPENVSIVTSGGLSIEKVSSYKYLGIWLDDKLSFKVHVDNLVTKLKLKLGFYFRNKACFPLMARKKLVQATFLSVIDYGDLLYMHAASSVLQRLDSVYHASLRFITNAKSLTHHCTLYQMVGWTSLYMRRKIHLYVFIYKALLGKLPLYLCSLVSFTTSSYHTRSARWLLLKVPRTFTVLGKTAFSSCAPDAWNSLQSMLHLDMLVPLNEFKILMGDSVTEECKCFF

SEQ ID NO: 3102 - protein, 23 aa, Betaretrovirus sp.
PLLETVAQIKHISETAKLFLQCQ

SEQ ID NO: 3103 - protein, 22 aa, Betaretrovirus sp.
PEIETATLSPRTKIYTELKHLQ

SEQ ID NO: 3104 - protein, 591 aa, synthetic construct
  source 1..591: note = Description of Artificial Sequence: Synthetic polypeptide
  VARIANT 392: note = Any amino acid
MDVVEKEGKRKPYKSNLSNNEQGVLKALKTKPYVYLPSDKGGEFCVIEKSRYCEAAYKHLSDSNTYKKISRMSPNTIETKINKVWKDIAAKMNLKKRLTKSFVTKNSDLPNFYHLIKTHKDGPSIKIRPIVSNTNGPTTKTSWLLSKILKPLLNNVPYHLQSSDCLMARLNKTGKTTHSEFKYPFSLDVVALYTSIDPSEAIECLRRRLENNLLIKEMNTENIINLLTVILENTYFTFDQNIYKQIKGLPMGSSISGLLAIIFMDYLERQTLRTIQSIGFYARYVDDIFITTKSKKEAEEIFHIFNEAHPDIKFEIEYPDENGSLNLLDLRIKIDVDTPTYGFYKKSARKEIFMHQRSALPYLQKVNVIKNEKQRIANRCTEGKENYKQQLXFDKVLRRNGYHKEDIERMNSKPKTPMDRTQKKKKYFYLNIPFISDTLDFKIRKELNHTGLPIRISHKSWTLRQALANNTKKENICTMENCQTPKKICFRKNVVYCITCNACKEIYIGSTLRNLHQRIKEHLDPAGKSSVYRHLQQCQPRKERKSISIKILAGDNIQKNLRFKEAILILDKHPSINTKEEISEIASLICC

SEQ ID NO: 3105 - protein, 2038 aa, synthetic construct
  source 1..2038: note = Description of Artificial Sequence: Synthetic polypeptide
  VARIANT 277: note = Any amino acid
  VARIANT 292: note = Any amino acid
  VARIANT 311: note = Any amino acid
  VARIANT 428: note = Any amino acid
  VARIANT 457: note = Any amino acid
  VARIANT 521: note = Any amino acid
  VARIANT 525: note = Any amino acid
  VARIANT 800: note = Any amino acid
  VARIANT 1116: note = Any amino acid
  VARIANT 1135: note = Any amino acid
  VARIANT 1136: note = Any amino acid
MSKNGTDPHLLELCYKAHVFLNGSKEIPLSTAVGHWREIDSTGIFDSDFSELMEQIIAKPFKTEGLQLKIENAIKTFDKFIADAVNPDKLINHKHLNFFYNQLYYNPLKNFNFSIPIKSILKNNNIPSHRNFFNNEESTPLNKKSISFKNISHSKPFSYLTALTNNLKYENIDNILISIRNCTDSFFINLNICFFELKHLIKNNFINYFNDYFYIFYLKIQKFNNKKLQKSNYYQNNIPLLFKISSLTNDFFINIENYFSKIKTKRNINLFLNDFLXILKIKINILLFKYSXFKKLNPKNKHEKISTRSSXASGRLALAVTPSSPLDLTINTTKQTTTDINTDTTNTSHKFSNNRYSLFLDQNEPLDLSIVKHPHKNTNIPSTVKNTYNPLNKQKPFHKTTTKTIFSNAQNNIKKHNIDTSKRPHFSXPIPKSCNTDIKYEIPPIEKNTPKLNDIIXSNITFNPKTPNIQQNISLPKFILPSNLHNNTTNVDLDAESTLVNPHFQLNFNLKPCPNLFIPKXDLPXNLNMEIDQKLLLTNTKASDETISYSPITQTQTDESVLTHKLIELISINTQANRIIEQINSDIDLFSQSPHSYEIPNTETKEIFTVYNNLDIAKKRVEIIIEEDILKTKTQTNDDIPMINFNNNYINNNSLFKNILLSNESVENLFRDISDNDSIISKSPNKKINNQDFLKKTVKINKTMFNLRNDGYLICIGGKCEKKKIGIHNIDNIIEHRKTNHSDTIDKNTTFLCLLCEGSVKRKTILLNKIIQHTETFHSEKHFPVTREELNNKNKILELXMNTEGTLNCRYTNIKKHCQNDLTYKSTYAQIEKHIAKKHKRKTCNINEIICHCGETLEHHNIIEHHNKHIGVLPAEDKLRMIPDNIPVSVKDIGNDISILSTFFCMHLLPQSQQLLYNHTLLKPSYKQNFKTFFETFPFSQYPNWNEIILPFKTSTVNWAVFYFNKLKAFATIIDPLSPNSLQKHRKIADTILNTIKNIQNIIYPSNINLTELNYPMCANTNESGFFICHIIQCISINHNYITIPIISEIRKRLDNLINKVIIDRAPIDNILKYTNILNNIKILQNNNSENPDEGLAEINRIHECIFPIKHKIKKXLSLIHHLLLLKIIKLNKKXXFNPPSTIIKNNKIELTYKLRFNFNINYKSTINKIFNNSINTLSPHPDRIILNFEREIIIINDIKFKYKLPYYPENFIHKPTTIEEITNTFKIVDLSSSPGKDQISYLDWKKIDPDNSILCSLFNNILFKSITPLKWKTFKTKLIIKPGKENSSHDLSSWRPLAILDTSYRLFATLINRRLLEWIKLGNLININQKAIGCPDGCAEHNSVLLLLNERAVRMGTNINIVWLDLADAFGSISHDLIWNVLTNMGINNNTIKLFKNMYNNCNTYYECENNHYNFLKICIIIVTLIMNVKTTTTKTIPINNGVKQGCPMSMTLFCLAINFIITNILKDHPFIINNYNVSILAYADDIVLISDNRIKIAKILTDIIKYTSDVKLKFRPTKCGFYENNRNHDEKPLKIYNEIIPIIDENNIYKYLGVGFGGKSNHNIDNILEKALTDAEATFLSDLHPSQKLFAYKTSIHSRLIFPFRTCIVKHMILDCDRNRIVDNRTKQLGFDQKIKRLIKNSIGDIFQNISNNFIYAHCSMGGLGIVPSIDEYLIQSTIQLTRLLMSSDVTMRDFIIGELIECVRARFNYLENEIEMAMKWLNGDIDDEKVGKPCLFLKFKKSVYRLKIKFSIICKLTYIDNIFSLEISKNDFKIVINNENIDNASKIMHILTGEWYALEWYKMTHQGHIAETVGKSQFSKHLIKSTTLGDNQYFFLIKARNNSLNLNSNPSNHKDKKDVNCRLCRIQWETQAHILNHCTLSQNARRNKHNHVLEIVHNFFASKNYDIDIEKSPPNVDTTLRPDLIIKTTDKNKIKLSLVDIKVPYDNETNFINARKQNLDKYRNLAIETGKDNNCKAAVYTIIVGSLGSWDKENNKDLQKLGLGVNEIGEMARMCIKAAIEASYMIFMNHVTNNK

SEQ ID NO: 3106 - protein, 1070 aa, synthetic construct
  source 1..1070: note = Description of Artificial Sequence: Synthetic polypeptide
MLSQHSRSQALVKEEGCDRLGEPTLNLAILMEMKPKRNPLGRNPLSDAPYRNPGMVLNGQGPGRLPLGDAPCRDLGMVSSEQGSGRHFLSGALHRRPGVVKNEQGSSHLSRRVRRARKLVEPTRIRVGSWNVGSLTGKLRELVDVATRRRVNILCVQETKWKGQKAKEVDNTGFKLWYTGTAANRNGVGVLIDKSLKDGVVDVRRQGDRIILVRLVVGDMVLNVISAYAPQVGHDESAKRLFWEDLDSLVRTVPSSEKLFIGGDLNGHVGTTSAGFEAVHGGFGYGSRNQEGEEVLDFAVAFDLMIANTFFRKRRSHLVTFSSGQHYSQIDFILTRREDKRACLDCKVIPGECVVSQHKLVVADFRFQMRARRDKQAKIARTKWWKLKEETSEVFKERVIKEGPWKEGEDANNMWEKMANCIRKVASEVLGVTKGGRGVDKDTWWWNEEVQRTIKEKKECYRRLFHDRSVDNIEKYKEAKKIAKRAVSVAKGRAYEDLYQRLGTKEGEKDIYRMAKVRERKTRDFNQVKCIKDEMENILVKEDEIKHRWQEYFDKLFNGENENTTLQLDDSFDDTNRHFVRKIQESEVREALKRMKSGKAMGPDGIPIKVWRCLGDIAIVWLTKLFNHIFRSNKMPEEWRRSILVPIYKNKGDIQSCTNYRGIKLMSHTMKLWERVIEHRLRRITRVSMNQFGFMPGRSTMEAIFLIRQVMERYREKKKDLHMVFIDLEKAYDKIPRNVMWWALDKHKVPTKYVGLIKDMYNNVVTRVRTSDGDTDDFPIRIGLHQGSALSPYLFALVMDEVTRDIQGDIPWCMLFADDVVLVDESRAGVNRKLELWRETLESKGFRLSRTKTEYMRCDFGTTTHEEGDVSLESQVVPRKDTFRYLGSMLQRDGDIDEDVSHRIKAGWMKWRQASGILYDKRVPLKLKGKFYRTAIRPAMLYGAECWPTKRRHVQQISVAEMRMLRWICGHTRRDRVRNEDIRDRLGVAPIEEKLIQHRLRWFGHVQRRPPEAPVRSGTLRRDSNVKRGRGRPKLTWEEAIKGDLKGWNIPKDLALDRSAWKTAIHVPEP

SEQ ID NO: 3107 - protein, 678 aa, synthetic construct
  source 1..678: note = Description of Artificial Sequence: Synthetic polypeptide
  VARIANT 11: note = Any amino acid
  VARIANT 171: note = Any amino acid
KTLLKVETNPXTSTNNKWFVNISKTEIPPSVSNLLQLGGNFCLPPNKKTSITEFIKDIESNRCIQKERGEIRNSVIPLLHNFLHNNSSLDEVEKELLRMKRATSEFCKSNPNVIFTRADKGNITVAMDRLDYINNMEQLLHDKETYSIIKNNPIKKVEKDLNTTIKRWYDXDFISKQSYFSLHSSDSTIPKAYGLPKVHKENFPFRIIVSSVNTALYPIAKFLHKIINNSLPFDSRQVYNSFDIAKSLSGMKIREEYCLLSLDAKSLFTNIPLDLAMDGIRKRWPSIENNTKIPFDEFIFALKFILSSTFFTFNNVFYKQTFGTPMGSPLSPIIANIVLHDLEEKALKSINLEIPFYYRYVDDIVMAAPPNSLNFILETFNSFHNRLQFTIELEQDRSLSFLDLSLKITDNTIIIDWFHKKTFSGRYLSFFSHHPICHKIGTIYNMVDRALLLSHPTFQQKNLELIIGLLLKNGYPLEFIFKYIKIRIKNLFNTKMAPIITNDQDQTKKDENTKKFIVVPYIRNISEKTTSLLDKNTFTFGYRCINKINNFIKVHKDKTERDCSSNVVYKIFCNNCDATYVGQTKRQLRTRAKEHINNIKLDPSKHSVITNHRIFFDHSFNWKDIKILDTEENYQKRLISEMIHIKQQTNGLNSQNDTDLLHDSYFCLLDSLKDNTNI

SEQ ID NO: 3108 - protein, 955 aa, synthetic construct
  source 1..955: note = Description of Artificial Sequence: Synthetic polypeptide
  VARIANT 805: note = Any amino acid
  VARIANT 909: note = Any amino acid
MMSRACDASMPRSRPMARRAAYWWSAELAELRRATVAARRAHTRAKRRGMEDALNNAAAVLREARKALRTAIARAKAAAWDELLSELDRDPWGRPYKIVMKRLRPWAPPVSETLDPQFLGEVVDKLFPTRGRDIPEKTGPPPGWTEELEVSRHEMVAAFARITGRKAKAPGPDGIHAKVWARASSIIGEALRGPYTKCLREGTFPRRWKRARLVLLKKEGKPAESPSAYRPLCMLDDAGKIFERIIANRIIRHMSRNGPDLSPGQYGFREARSTVDAIRQVRSLSESITGDGKVALAISLDIANAFNSIPWGEVVAALSEHFRLPPYLVAIVRDYFRDRVLEFRDKTGLQQRRDMSCGVPQGSVLGPLLWNATYDKVLRGALPPGCHVVGYADDTFVVAGGASWVIAIAMGNWAVNCVVGSIKSLGLRVAPEKTEAIFFHDGSSRVPPRAFVRVDNTRVRVGATLKYLGLLLDGRWAFVEHFDKLAQRLGRRTDALLGLMPNLRGPRVGARRAYAYAAMAGALYGAPVWFREALASRRIRDVLHAVQRRLARRIVRAYRTAPSAATMVLAGLPPAEFTADALAWSYARAKAVRLQGGVVTPRVAALLRERARRRAMRAWRESLANDPPAAGSRILEAVLPHLDEWVGRPWGGLSYRTTQVLTGHGCFGEYLCRIRKEPTTQCHHCEADRDSAQHTLEDCPAWEELRGVLREEIGDDLSLRAIISQMVSRERAWVAVSSFCEQVMRQKEEAETVRERRPGGRMPPGEGNDGRGGGDGGHDPPWLPPRPPRRRRPAPRPPGPAARLXKGGGGPADQPRSPPPSPQLRRRGATAPIWRGGGDPPPLRLPAPPSGHAAAGGGPLTPASPARQTRPDGPGGATLRHNAESLPPLPRRGGGRGKGLLSPPQGRKXGRAAVSAARRGPGLRRGPDTPGLYPQQHQGKRRGRDGVPLPRPRAD

SEQ ID NO: 3109 - protein, 989 aa, synthetic construct
  source 1..989: note = Description of Artificial Sequence: Synthetic polypeptide
MVTPLRAIGGRPKSLRPSRRARQATESIPPARQSLASYPSRIRYANNSNNNWPHSPVTERAPNTAALRKMSKERLKKSRGRTRLPKRRKTKMIVCTFNARTLASEASIEDLMVQAQKIKYDIIGLTETRRHQSHHAIFDTGEELFLGTCDNRGVGGVGVLVNTNLAMSIDSFECLTTRIGRLRLNRCGSLPAVSIFVVYAPTSNYDEEEIERFYMELEKFYKEDHTFYKIIVGDFNAKIGPRRSPEELHIGTHGLEWNDQGERLSEFIMSTKTIHGNSQFQKAESKRWTWESPGGQFHNEIDHIIFNRRFCLTDVAVVPKFQTGSDHRLLRAKFYFTERGEKSAKFKSKKATPRMTTNWELFGTIAATWEDAVLDNIDEEYDRLVQHLHVCAKNAESEKATNRRLSSETLELIRQRGLARASGNHKLTSELTKLCRDAIKEDLKERRAAVLASAAEAGKSIRNARLSFANYKTKMTALRRPDGSITSSRKAMEKIIHDFYSDLFDSHVHLPTYQIPQDGYVVPNVLPSEIRHAISLVKTRTAPGPDKVRPEHLKNLPPVLINTLARLFTRYLSECKVPSQWKTSRTVLLYKKGDIHDIGNYRPICLLSVVYKLFTRVILNRIGRTLDEGQPCEQAGFRRGFSTIDHIHTVTKLIEVSREFKMPLCLTFIDLKKAFDSVETEAVIEALAKQGVQTQYIKILRELYCGFTTRISPFYKEVIIDVKRGVRQGDTISPKLFSAALENIMRRLEWEGMGVKIDGRQLHHLRFADDIVLITPNISQAAQMLADFDHECGKVGLQLNLNKTMFMKNELVPEAPFALNGTNISECSSYVYLGREINMRNDLVPELRRRKRAAWNAFKSVEEVVKRTKNLRLRAHLFDSTVLPALTYASETWALRKQDENAIRVSQRGIERAMLGISRLTQVREGIRSSDLRRRSKIRDAVSFAKASKIRWAGHVMRFRDDRWTRAVTDWIPRDVRRPRGRPPTRWSD

SEQ ID NO: 3110 - protein, 893 aa, synthetic construct
  source 1..893: note = Description of Artificial Sequence: Synthetic polypeptide
MKMPNRAASQSNSAEGPLSRPALTVLSWNAEGISDAKEEVLAHMCKQMNCDVLCLQETHRGSDNPRPKIKGMKLAIERPHRQYGSAIFMNEKIRPDSTSYTHNNDIEVLNVTIKGLTISSIYKPPNISFSYPSTTTNRHIVIGDYNSHSTQWGYDTTGDDGALVETWAQNNDLKLIHDPKLPKSFASARWKRRYNPDLVFCSRLLAPTSRKFVAEPIPRSQHRPIGIQLTAVITPNKTPFKRRFNFAKADWPAFTEHLDHALTHLPADPKNYESFIDIVKKVSRTHIPRGCRTTYIPGIDEESSQLLANYTTAYDTDAFSEDTINLGEELISRISQRHRQMWQHMIETTDLRHSSRKAWATIRKLGIDSTRAQQHYNVTADEVANQLLKNGKAPKTTNSHRHKLPGVDQNMSLFTRPISEEELQKGISTLHVNKAAGIDDIRSEQIKHMGSVAQKWLLDMFNNCIENTCVPKQWLRTKVVAILKPGKDSNEAKNFRPISLLCQTYKLLERLILNRIGPHVDSQLNCEQAGFRPGKSTTGQLLNLTQHIEDGFQNNLITGAVFVDLSAAYDTVNHRRLQTKLHDITNDLKLTRFIQKMMQNRRFFVELDGQKSRWRKQKNGLPQGGVLAPTLYNIYTADIPSTENTRNFIYADDTCITAQHSTFEAVELHLNTALASLSEYYRANYLRANPSKTQVCVFHLKNREAKRELKLKWNNVQLNHCEHPVYLGVKLDRTLSFKKHIEKTIGKVESRNAIIGKLASSHYGADPKTVQSAAVALCMSSAEYACPVWSRSAHVKKLDTTLNNTYRKITGCLKPTKVEEIYHLAGIGSPNQRRTNTCLKERMKQATDDRHMLHGYLQPHKRLISRHSFLDSVPPPEQNPPPSAKPVLIKGLT

SEQ ID NO: 3111 - protein, 1076 aa, synthetic construct
  source 1..1076: note = Description of Artificial Sequence: Synthetic polypeptide
MDTYKVYVLFYIALCIIIGLRGHSSYSKHETAFVPVRAPSRAHKQLHRSGYHKTPIKYYANASATFTLPIICCGDVESNPGPFELTSCNTNKRYKYTRGELVNINSNSCGKSLRLPVQTWKTISELEIGKEFKTRRGCRAGVRKLKHFKHPIPIILPTARTKLPKKYPRFPRRRCLTSVPVAPQSGCDLPSFLLSNVRSACNKFDELSAVISYLHVDIAAITETWFRNDCPLDNFSIPGYYLCTKSRTNRIGGGVAIYVRELLNPSPADVQVPINLEVTWVKIRPPRLPRSISCIYCAVVYYPQPDVELETELIDHLETTIDVILTNHTDAGFVILGDFNRMNIDPVLLTHSFRQVVDCPTRGAHILDKIITNIHQFYDKPQICSPIGMSDHNSIMWFPLKIKPKLPNTTRYVFNRPMTDSAIRAFGQWISSYDWPEVTEDVDVNVRCGSFYSTLNNAINIYFPVRKVLLHFRDKPWMTGEIKSLIHKRQIAFHQGKGILWKRLRNKVNSSIQKAKVKYYRSRIQKLKKSNPSRWYQEIRILTKGSRQSLNIPVDGVDPSERDKIANAINEHLISVSSDLQPLNLAALPAYLPSRSLPEVYPWQVNKVLSKIKCSTANGPDNISARLIRLFSVELSGPLTYIINASFSQGKVPASWKCAIVVPIPKVNPARIDKLRPISLTDHFAKVIEGFIAKWMYQDIAQHIDPCQFGNQKRLSTSHCLINILHYVFLNAEVPKTSSTILLTDFQKAFDRIDHTVAIKKLIEIGVRPAVVYWISDFLSERKQRVRYHSDLSEWCQINAGVPQGTKLGPLIFLVMINDFKSSESIHMFKYVDDLTLVECRKTNQISNMQEAVECLSLWADINKMQLNPTKCIKMDICFSRVPVNQSSIILENCVLSTVSQVKLLGVTIQNDLKWEAHVRDIEKRANAKLYMLRSLGKFGLSHEDLITIFIGYIRPILEYATQVWSGGLTSAQKQRIERLQKRALRIIFGKDYHSYANALTKSKLQTLESRRNDLCVTFFKKTLSCTDQFKQFIPQRAHNRTLRRTNKIPEPRCKTKRMQNSPIPDLIRLYNKSFL

SEQ ID NO: 3112 - protein, 938 aa, synthetic construct
  source 1..938: note = Description of Artificial Sequence: Synthetic polypeptide
  VARIANT 463: note = Any amino acid
  VARIANT 475: note = Any amino acid
  VARIANT 602: note = Any amino acid
  VARIANT 615: note = Any amino acid
  VARIANT 622: note = Any amino acid
  VARIANT 649: note = Any amino acid
  VARIANT 665: note = Any amino acid
  VARIANT 727: note = Any amino acid
  VARIANT 774: note = Any amino acid
  VARIANT 809: note = Any amino acid
  VARIANT 916: note = Any amino acid
MMRQTNKNGYRPGCRPGEQEPRPPVTNQAEVGKLNTGFKSKSRIKIIDCKAATLISSFNVRSLKSKEKMGELTALAEEKRIDILCIQEHHIYHENVDIQMKDMGKGWVLAMSSGTKNTVNSTVGGVGILMSPFAYKSLEYLEKVSSRILLAKFSGNPAPTVITCYSPTNCSPDNEAVNFYSLLSDVIKKIPQHNMKIICGDMNAQVSSADSKGFTFGNRTNRNGQYLLNMTFECDLIACNTRFQKAKEKLWTFTYPNKSQAQLDYILVNKKWRNSVKDCQAYNSFGPLNSDHRIVSTKMQLSLRSNKKVKAKSNLPHDWQLFKSDCSIKEAYTVEVNNRFEALYQDIENPTANEIYSALIEAHEGAATKYVPKRKGKKKRVPWENEKIREKRKCLKVAYNKKNGAPTAEHAETLDKAKKDLQDAYDEEQSNYIAQKCTEIEIGAVQQQTRKVWDIVKEITGKXSTPVDQLRGKTXQERLNQWKDHFSNLLGQPPPDNNNPVSKFTIAELKVAVTSLSNNKCPGVDGIPAEVWKSGALDQQLLEVCNRTLIHGEKPDLWSRSIIIPVPKKGDLSTPQNYRGIALTPIAAKVFNKMLLNRIRPXLEPLLRKNQNGFXPGRSTVXHILTLRRLVEGIKAKHLTAVLTFVDFXKAFDSINRKKMLKILXAYGIPHTIVTAVGVMYKDTTAQVRSPDGETDSFTILAGVLQGDTLAPYLFVIALDYALRTAXEGFEDLGFTLQERKSSRYPAVMITDTDFADDIALISDDLEKAQELLXQVESAASQVGLQINSTKTEFMLRNLREGEICTADXTKSKQVQNFQYLGSWVISKQDLNIRKAKAWTALNKLTAIWKSNLGRKLKVRFFTVETVLLYGSEAWTLTSSLEKQLDGCYTRLLRAALNVNWRDHMTNIELYRDITXISARLRDRRLRFSGHCWRSKSE

SEQ ID NO: 3113 - protein, 765 aa, synthetic construct
  source 1..765: note = Description of Artificial Sequence: Synthetic polypeptide
MVITNTWFKEHPRRVYTWKSPGDIVRNQIDYIAINSRFKRAVKQSKTYPGADCGSDHVPVICTLQCKLKKLKRPKVVKILDFKQLSKPDIRQEFTVQVKNRFELLIDEGEENTWETMRNILVETAEEYVPTKERKRRNKWMTEEILLMMKDRQKIGNRQCKKYRDLDKQIRQKCNEAKESWLNEQCVEIENQFDKNSNVYQRINEISGKKSGCSNPGCIKGKDGSILFEMKDKMSRWTQYIGELFEDSREAMPSFADEVKGEKILKSEVRWAMSKMKKNKAAGPDGVVTEMFEALEEYGVDRLTEIINKIYDDGTFPDELGRSIFITLPKKPGAVDCEQYRTISLICHITKIILRILLLRARSRITPMVGREQFGFVKDAGTRNAIFVVRNITERAVEMQKDVYMCFIDYSKAFDKVKHSELFEELKKLDIYRKDLRLLQSLYWNQFACIRVEGECSEYINIRRGVRQGCVMSPDLFNMYSEIILRELEDENGIQVGGHSITNIRYADDTVLFSESEKDLQRLLNVVVKESERMGLEINYTKTKCLVVSKKSSPKCNLKLKEQIIKQVSSFNYLGSMIAEDARCETEIKRRIALAKSAFSKLGKILTNRTMSMRTRIRVLNCYIYPVLMYGSETWTLASDTKKRLESCEMWFLRRMMKIPWTDKVSNEEVLTRAGVQRKMIREMLIRQLKFMGHITRKEGLENLALTGKIVGRRSRGRRRILWMDSLQKLLEERGVKELGVVLIQKARSRGLWNSMIAKVKRYGT

SEQ ID NO: 3114 - protein, 1050 aa, synthetic construct
  source 1..1050: note = Description of Artificial Sequence: Synthetic polypeptide
  VARIANT 36: note = Any amino acid
MRNSMKLHTGSVVFRVNKDRAVRSGLPSTVPSMLGXKQQQQKDDTSGITTMTFGQWNVRTLLDREGTGRPERRTALVAMELEKYRIDIAALSETRFSESGRLDDMGYTFFWSGKPDGVRREAGVGFAIRKEILAKLTEMPKAVNDRIMTMTVPLTKKGNATLISVYAPTMTSPDETKENFYNQLRRTLRDTPRTDKLILMGDFNARVGRDYEKWQSVIGRHGIGKCNTNGELLLALCSEFELLLTNTVFKQREEHKTTWMHPRSKHWHLIDYIITRQRDRMDVHSTRTMRGANCLTDHQLLRSKIAFALRSKRRKQGATKLAKLNTDRLHVNTQRLNLEQDMEKALTNWGVQEGMTVDQTWASLSKVVYETASNTLGKPERKHQDWFDPEDSELLILMKKRDETHQRVLQTRSTRSTTTAYKEACRHLQRYTRKMKTTWWEKKAEDLQRSADNNDMKSFYTGLKEVWGPQTRSTVHLKSLDGNTTFSDNKRVLERWSQHFETLLNQPGDIEPAARDRINQRPVVTALDDIPTRKELNLAIASLGDGKAPGVDGIPSEIWKHGGATLTNSLLMLIQQAWAEGSVPQEWKDANIVTIFKKGDRTQCGNYRGISLLSIAGKVFARILLNRLNAHITPDILPETQCGFRNNRSTVDMIFCLRQLQEKCIEHNRSLYVVFVDFTKAFDTVGRTGLWQLLRKYGCPEKFTGMIESLHTGMMAKVKEAGETSDSFPVSNGVKQGCVLAPTLFSIFLSAMLEEAFADFEEGVYIQSRQDADLFNVAHFKAKTKSTQILVRELLFADDSALVAHTPEQMQHVIDVFSSASKKFGLQINIKKTEVLFQPGTDHREEEEILVDGTALNQVDDFTYLGSTISKDGRIDSELVKRMSKASSAFGRLRTRLWNNHHVSTRVKCKIYRAIVLSTLLYGAESWTLYKSQVKKLHAFMMRHLRAIMRISWKDKVTNKEVLERANLPSMEDLLIRKNLRWTGHVIRMPSERLPKQVLFSQLPAGERGIGRPRLRYKDTIKRNLKRRQIETKTWTTAAGQRAVWRTAVK

SEQ ID NO: 3115 - protein, 986 aa, synthetic construct
  source 1..986: note = Description of Artificial Sequence: Synthetic polypeptide
MNSHAHTPDILVDDINESKYYTPQEFKNSFSYKPDNISLLHINSRSLNKNFEYVENLLHSLNNFAFSVIGISETWLHQNSPDMFNLPNYKLIRADRKGRRGGGVAFYITQNLNFKIRSDIKLTQAESLFIEINNSNVKNVIIGLIYRPPDSNCELFCDELDFYLHKIGDENKHNFILGDFNINFSPSSDNSNSTNCMQLMHSYGFFSIINKPTRINPHSSTQIDNIFSNVHNNKTIGGILCSEVSDHLPIFLTCECKLSCSKSFDELYRKESKRNIELLKQDLFFEGWAEVYNVNDVNTAYKHFSNKLQYYYEKNIPLGKMSNKRNKPRNPWITKGLLKSIQTRNRLYKLHLRNPTDTNLNTYKIYRNKLTKLIRTSRRLHFSNKIKKASSNTTATWKIIKEVMGKKTNPPPTDNITLNGTKIHDPSLHANSFNSFFTNIGPELASKINRTHAHFKDYLSNQNQESLFLNPTNPSEIINITQSLNNSKSHGFDRISMSLLKEIMYPLAKPLTHIFNHSLSQGVFPDLLKIAKVNPILKKDDPHEISNYRPISLLPSISKVLEKIVHNRLHKFITKHKILNSNQYGFRKNYSTDLALIQIYDKITSAIANKEHVIGIFCDLSKAFDTLNHAILLSKLSHYGIRGQPLLWFKDYLTNRRQYVTFNSYDSDPLLIQCGVPQGSILGPLLFLLYVNDIINTSPLLSFILFADDTNIFYSHKDLNSLNNTLNYEINKVSDWFKSNKLSLNTKKTHFMYFKHHSHNTETPIYIKIDGMLLEKKTNSKFLGVLIDETLTWNDHLHQVTMCISKSIGIISKLKFLLPHATLFLLYNSLVLPYITYCNSVWANCGSTKINSIFKLQKKAIRICTGSHFLAHTDPLFYKLKTLKIFDLNTTQVAVIMFKYINNLLPPSFDNMFRFNNSVHSYSTRISGNFHLTNPKLSITHKSVRHSGPDIWNDFPDNIKSCSTIYSLKATLKRQIIQSYAPHSLN

SEQ ID NO: 3116 - protein, 1075 aa, synthetic construct
  source 1..1075: note = Description of Artificial Sequence: Synthetic polypeptide
  VARIANT 76: note = Any amino acid
  VARIANT 105: note = Any amino acid
MGRKPKYPCGVCSRAVTTRTTGVQCEGTCLKWFHAECIGLTSTEYVAFDSSSIVWICNHCGAQNLAHSCLSSLQLXPDTNRFGVLDPDGQNVISEENSNSCRPTXDSSNPSSPGSPAYSSSPQNIKQRRSKHKPRPRVLRFLNVNCQSIRAKMQPFSILVHQHNPDIVIGTESWLSDGINSNEVFLDEQYSILRRDRSNDPHGGVFIATKTDLIVTREEELETDCEILWCRIEMAGSKTLRVAAYYRPKEDDEVSLAELQRSLSRLDRRHLVVLAGDFNLPGWKWDGPYVGPCAYPALHHQFGEIINDHGLTQLVKEPTRQANTLDLILISNPTLVNSVKVVPGISDHNCPVADIDMSPPRRYQPKRKVPMYKKADWEGFAELMQHVADYICSKSSSASVHDLWQLFKSGIEGGIQTFVPHKMLKQKQDLPWITSGIRKLIYKRDRLHKQVTRLRKQNMLVPFPLETELQHLKRLIQAESRKAYWSHLESIFTADGPNEYEGMKRFWKFVKNNRTDRCGIHTLKTDEHTITSPQDKAEALNKQFKMAFTNETDVPADLLPETSPYDSMPDIHISTEGIVKMLKKLKVRKAPGPDGIPALVLRKLSRVVAPSLRAIFDVSYRTSEVPDDWRLANVVPIYKKGDKTDPENYRPISLTSIICKMMEHIFASNIMGHARRNSILRPLQHGFQAKKSCELQLTGFVTDLLNNMEDNNQTDIVITDFSKAFDKVGHQRLLKKMEYYGVRGHNIDWISSFLSNRKQQVVLDGHTSSTVEVQSGVPQGSVLGPCLFLFYINDLPNQLSTKVRLFADDTVLYHTIQTPEDAELLQQDLDQLCGWSSKWMMALNPKKCQVITVSRKKTKYVHRYSLNGEILESVSAAKYLGITLTADLNWTQHVSATCKKANNTLAFLRRNLRVNSTRLKTTAYQALVRPLLEYGSAVWDPHTIRCVNQLEMVQRRAARYVLNRYHHTSSVSDMLSQLGWTSLQKRREHQRLTLLYKMHYSLVDFDIHHYIQPATVVRTTRSSRPYCYRVMQSRTEQHIHSFFPRTVRQWNALPLEVVLAPSVEAFQRQLKTGGK

SEQ ID NO: 3117 - protein, 994 aa, synthetic construct
  source 1..994: note = Description of Artificial Sequence: Synthetic polypeptide
  VARIANT 143: note = Any amino acid
  VARIANT 177: note = Any amino acid
  VARIANT 320: note = Ile or Leu
  VARIANT 443: note = Any amino acid
  VARIANT 444: note = Any amino acid
  VARIANT 945: note = Any amino acid
MMADTSTCVLQLNAEGPYPLKARSDYPHIAKENWVNVICLQETHCETEEQLHIEGFDLICFIPHKKHGIASYVKQGMKASTTGRSPVNSALQWSTFEAMGTHFCNLYKPPPVDVEIILFPKMPRNSFVCGDFNSRSTAWGYPXTNKNGKLIFEWLESQELVILYDSKDNPTFYSGSXKSWTCPDLSLVSSNIRHTCSRTVLPKFPRSGHCPIIISSDIKLQLSNLPKKRWNFRKADWPKFQELTNNKLTSRLPDPSTSNVNDSYSAFCSMLHQAAKLSIPRGRRHPYIPCWDEECDRLYESCAKSKTIEEREAVGNDLLXSLGEKRRIRWEEEVSEINFTHSSRKAWTTINKLTGRSSAPKQCPVTANSIASVLVNNGKWQDKTTEAKAHSRSVNSEIKNLLKSTPESTSMSEAFTLDEVETALKSIKSGKAPGNDNIHTEFXXNMSRKATSWLQAFLSTCMTTSTIPSKWKTAKVIAILKPKKPADEPKSYRPISLLSHIYKLLERLLLARIVDTVEEKLPTTQAGFRKGKSTTDQVVRLVNNIETAFQKKQKFGAVLVDLTAAFDTVWHRGLYLKTLQTIPDVRIVKFIMLLVQDRSFVLETSNGECSRKRKLRNGVPQGSVLAPILFNIYVSDMPKGECMQYSYADDTALGFDNHSFEAIKTSLEKDLKMLAEFFNRWHLKMSIPKTVSSVFHLANRCANRELNISLDGSRLNFVSTPKYLGVTLDRSLTFHEHAKATAQKTQARVSLLKKLAGTGWGANFTTLRTSTLALAFSTAEYAAPAWSHSTHVHKVDVVLNDAMRLISGTLTATPVSNLPILSGIPPAQLRRDAQYTKLAQKHDRDKCLVPAPSAFEGQRLPRRHFATQAAELPLEKPPSTLATWIAKRWSDLQWNSSTTNLKEFIPKPCAKPSGSDLPRKAWVNLNRIRTGVGRTQYFLHKIGAXSSPNCACGEIQTMDHVIDDCPIYKSPHGASGLRELDDETICWLNKDLPI

SEQ ID NO: 3118 - protein, 952 aa, synthetic construct
  source 1..952: note = Description of Artificial Sequence: Synthetic polypeptide
TDTDRGKQSKFKRKLRDRKLQIFYTNCDSLLNKRNELLLLLQSHDVDLVLLTEVFPKNHQNPLTHRDFILEGYDLHCNLEDGNRGVAIYIARDLYHLVGECDLQHSFHESVWILITLRGSDKLLIGCMYRSPSLDNHEELKRAFTQVTSINSSHVLIAGDFNYPNIDWKLGRARSHTEQEFIETVADCYLHQHIGEHTRYREGQRSSMLDLVFTNEDGMINHIDYVPGIGRSDHIGILFGLTVYTPDTHTPTPHLQFYRGQYDDMCKELDQIEWESELENKSVEDAWEFFLVTLTEKMEKFIPKSKPKHRRKKQRWMTREALRKQSQKHRAWKEAQRTKHPVDIMRARRLAKQLQTLTKQLCRNFEKDLAMNVKSNPKAFWRYTNSKLKTSCRLGELRTPDGERISTDKGKADALNTFFATTFTDEDKGHIPKLPPRHKGETLTSISISEDDVYKKLVHLSKYKCAGPDGIHPCVLKETAASVSEPLSIIYNASLKEGKLPSAWKVSHVVPVHKKASKMDVKNYRPISLTSVPCKILESLIRDEIVAHLMENDLLCDEQHGFVPGRSCVTQLLTVMEAWTEMLDKGTPIDVVYLDFKKAFDSVPHLRLLSKLETYGICGQIKEWIADFLQGRCQRVRVNDKLSDWTKVRSGVPQGSVLGPTMFVLCINDLPDGLQGSVKIYADDTKLYGKASTKDDLCSIQSDLDALMEWSNTWQMHFNTQKCKVLHIGPGNVKHIYALGDDVLEATSEEKDLGILIDDELKFHNHVAYAVKKANGVLSCIRRSFECRDRSTIPKLYKGLVRPLIDYGDSIWYPRFKTDSKTIERVQKRATKMIYDIRNRPYIERLRALNLPSLEYRRRRGDMIQVFKIIHGLERIPVDTFFEHSTSNTRGHSLKIVKQRCSTKIRQDAFSQRVINDWNTLPEEVVTATTVNAFKARLDRVWKDKRFCSPYE

SEQ ID NO: 3119 - protein, 541 aa, synthetic construct
  source 1..541: note = Description of Artificial Sequence: Synthetic polypeptide
MVDRVSLWHKLLRSGVDGKVFTVIKNMYSQAKSCVIVDGQMSEAFQCDVGVRQGENLSPLLFAIYLNDFEDFLSKHFKGLKFLVENVCADILDKEVNKDLFLQLYTLLYADDTLILADTAEELQVALNALSQYCKIWKLSVNAMKTKVLIFSRGKVRKFPVFRFGEDEIDVVDDFVYLGVQVNYNGSFKKAISKQVSQARKALFSMSLKVQRLKLPLDIQCELFDQLVLPILIYGCEVWGYEDLSQIEIFHRKFLRSALCVNKFTPDCMIYGETGRAWLANSIKHRMVSFWLRIVKGSPSKYSVKFYFLQRLISQNVDMSTSFKWLSCIEKILNHAGLGIVWLKQGEGFSNSWILSTLKLRLNDISKQDVMATIWTNSVCLNYRIFKEDCLFERYLVLLSKKDRITLSRFRCRSHRLPINNNRFKEAVNEISIECPCCDMHESGDEFHYVFVCPFFRKERELYLGRKVIVKRPCTSHMLNLFSCSGIGQLKKLVLFLRIIMSYFARLYTCKSEQSNHMSPIKRNVTTRSGRLIKQPTILDL

SEQ ID NO: 3120 - protein, 1047 aa, synthetic construct
  source 1..1047: note = Description of Artificial Sequence: Synthetic polypeptide
PSQRVNIELCCEITVSADKLAPNMLDNFGIIVVLSVIASLPHFIAESRPALLAGVTMEFQLVQNSIDTERYSDQYRYTKDELLSLRNTSHSRLPDNVFARIKELGIDKRRGCRAGSHKWRKIAVVEGRRRRTPKPPGVRAPQLIPIKTITTVSTDRQSQGNLPTIYMCNPRSLNNKLDEFSVVVHELCCDVCVVTETWFRADQPESDFAVDDYLVFAKSRDSRRGGGVAIYAKPESMPKTVNFLPPHPHHEVIWLQLRPKRLPRDISCLYVAAVYSPPDNDCVNDLIQYLVNAIDDIKTRHGDAGVVILGDFNRADTSELTSTCNLRQVVRKATRGTAILDLILTDIHQWYSEPEILSPLGLGGDHNAVLWKPKLNKTNSKNKAVRKFVRPMKDSAIREFGQWISQHTWDDVMASSSAQEKCDKLYASLQNAMDEYLPMKSVKMHPRDKPWVTPYLKSLIGQRQKAFSNDRTEEWKRLRNKVQNKKTELKKNFYKDRVLKLKRENPSSWYKHLKIMTSSKTASNIIIPESPELDDLAIADCVNDHFANVSQDIPELDLQSLPAYLPTPKPQLTVQPHEVYKELNRIKPGKSSGPDGIPARIVKEFAVELASPLCEVLNSSYHSGSVPSQWKGAIIAPIPKEKAASSIDKQRPISLTDHFAKIAEVFIYRKLLADVRHQLDPKQFGARAGRSTTHCLVEIYNFLCKRAELPSNVTSIVSTDFSRAFDRVDHTILIRKLITLEVHPWVIVWICSFLTDRQNQVRYHGELSSTRSMTAGVPQGTRLGPLLFLVLIDDALRESEVERWKYVDDMSLASAEPSNQHGQFMQNVLVNLEEWCNQNNVRLNPKKCNIMRVTFSKTPLPDRDFSLCNDVLQEVSAVKLLGVILQRDLKWNDHVSVTISRASSRLYMLRRWKEFHLPAADLVTVYVGFVRPLLEYACPVWHSSLTCAQSAALERIQKRALRLIFPGTSYNTSLDLARIVDLETRRKTLCINFATKASRSEVGSDWFTENNPTRNLRKNKRYREPRCRTNRYQNSPIPFMTKLLNFN

SEQ ID NO: 3121 - protein, 715 aa, synthetic construct
  source 1..715: note = Description of Artificial Sequence: Synthetic polypeptide
LTKTEKDLLSRGLNSAVTPEELPVVDLITATETAIRNNKLPETEAEQIRLKVSAALANAKAPASNITAQEKRALASLAKDKDITILPADKGRCTVVLNTTDYDSKILSLLGDSNTYEKLKRDPTSTYKKKVIDLLQKLEKEQAIDKPQYYRLYPGEATPCFYGLPKIHKEGTPLRPIVSSINSVTYNISKFLASILAPMVGNTPHHIKNSQDFAEKVSNLQLESGETMVSFDVTSLFTCIPTSEATEAIHKRLLLDKNLQERTTLSPAQICTMLDLCLNTTYFQFRESFYRQKHGCAMGSPVSPIVANLYMEEVEKRALLSFTGAAPSRWFRYVDDTWVKIQTKEVEKFTTHLNQTDTFVKFTREDVKGDSLAFLDCEIRIEEDRNLSIEIYRKPTHTDQYLLFDSHHPLEHKLGVIKTLQHRATKVPTTSHGRKKEQDHLTTALKTCGYPDWAFTKTRKKRDPSNEEEKDKRHSVSIPYMAGVSEKFRRILQKHNIPVQFKPSNTLRQKLVHPKDKTPRHKQSNVVYAVQCQQECRDLYIGETKQPLHKRMAQHRRATTSGQDSAVHLHLKESGHSFEDNQVRVLAREDRWFERGVKEAIHVKMEKPSLNRGGGLRHHLSPTYNAVLHSFHKQKPKHTHSFTRAGVTSPGDPAVKRKTSQTETRSTTLPTTLPTTPETSIQTTGILMQRLSVDISMPMVQKGYIFKLCTEPDQN

SEQ ID NO: 3122 - protein, 23 aa, Betaretrovirus sp.
PELETVPFIKSSTNATPLFSKLQ

SEQ ID NO: 3123 - protein, 1288 aa, synthetic construct
  source 1..1288: note = Description of Artificial Sequence: Synthetic polypeptide
MSVCYKCKSSVVNSIACLNCKKAYHPSCLRAFKNYSAIGQDLTSISACPCCDKLKSLQNPTSPTLNISTNTIFEDLGILKQETDLIKKTLDDLKTFITESPTTVCTFDKIDEYVRKSFDDLESKLISLLKDTLNREIEKLKNSIKNEVIAEISTNLNRTNDNIKTANSSDLTLKSTNSKNVSTQSVSKTNRYKVRIFADQKGRHCIDLLETYIPVSKYVIQSVVKPYSSLQELLKTENNNEQLGNNDFVVIYAGNHEAQKGKIPDENTLNELINHKFLNTNIILIGCPYFVNRPILNNFVYELNCNFYNVAKNNKNIYYLDSNDKIFDQFKTDNFVINKAVKRCIIKNLGDLITECQDHTNRSAVEQNPVATFLDTSLPSVDKSDSQSFLSVFLNRFVCLQPSHSKISISINKKTVNSFHGIYQNVRGLKSKSVTFFNSFLSTSDEFDLIVITESWLDDTVLDGELFSDNYYVFRRDRDLRHLGIHRGGGVLIAVNNKYNCRQLDISNISRRSSPAIDLVAIKINVTSYQHLFVFVVYIPPSISFSDFDNFFDLLNNFDEINNDNVLFLGDFNTPLFSGFSKNNFSISLKHFASFHNFNQFNNIRNNRNNILDLIFSNMDCAVSKSSFSFVPEDPFHPSLEFTLDIVAKTPDKFYMNRDHVAFNFKKANFDCLYTTLQVVDWSELEKFSDVNEACRVFYETLYNCFELSVPKLFCRKNYRTFPTWFNTDIINCLRRKSNILKKYRRTKNMHFYEEFKKLRSLSKSLITTAYSQYIGHMENTISKDPKKFWSFVQAKKRNSRIPGVLYHNGNAISNPNDIVNSFAKFFKSVFSDMTLTSDSPSMMTNLNSFITVNEINEHEIIRVLKRSKDTLTAGCDGIPSFLLRDCAHIFSKPLVYIFNLILQTSTFPNIWKIAHVCPVFKTGDITQIQNYRPISILCNFSKVFESIIYDRIYSSVKRFISPSQHGFVEKRSTVTNLACFTQFISDALDRKGQVDVIYMDFKKAFDQIDHHLLLLKLDQYGFSGSLLSLIKSYLANREQRVKYRNYISDSYVATSGVPQGSNLGPLLFLLFINDICGSLSTCAKLLFADDLKIYTEIKSIEDCLTLQNNINAVVKWCNENRLYLNPSKCNVMSYTKKREFLEFVYDISSVTLHRTFIIKDLGVIFDTELAFSEHIRDVTARAIKSYGFIYRNCRDFKNLSVMKTLFFSLVRSKLEYGALIWHPIYKIHIDQLENIQRRFLKFLVFIIDGNYPIRGYDQNLLLNRFGLQSLQFRRICIIIKFLYNLIN

SEQ ID NO: 3124 - protein, 603 aa, synthetic construct
  source 1..603: note = Description of Artificial Sequence: Synthetic polypeptide
  VARIANT 84: note = Any amino acid
MALRAARKNYYGQRIQNADNKSKCAWNIVNKICGRSKKCCEIQIEGDPKQIVNDINQYFINSAPFVRSKSNNNTISSNAKTMYXYPVTSQEIITIIQNLKNKKSAGFDEISNNIIKYCNEEISAPLSFVIQNSLDYGIFPEQLKRAQVLPIYKKGDPTLISNYRPISLLSSFSKIFETVISSRITNFLMKFQLLNSSQHGYIKGKSVDSAIFSFTNALLDKLEEKKVVLGIFLDFSKAFDCLDHNILISKLKKYGIRGIMLKLITSYLNNRYQQVTITKNSTVYTSNKLLIKQGVPQGSILGPLFFVIYINDLLNILTVSDNNSAVNFADDTNILIWGENMTDTMKEAKICMNKVINWTKENKLVLNFEKTYGIHFAICNHKNTEKPNKIVISSKEIELIEKTNFLGICIDHKLSWTNHIDNLLKKLNSVHFTIRVLKKYINIEQLRIIYFANFQSLLSYGIIFWGQSGKISKVFVAQKQVMRTMFNLKYNETCRNIFKSNNFLTVTGLYIYRLLLFFFKQNLLFNVTNDHKYDTRKVDLEYPRHKLTLTEKNSYYAGIKLYNSLPVHLRTPCNLNLFKKKIFDYILDLEPYTLNEFYNRQVF

SEQ ID NO: 3125 - protein, 31 aa, Spumavirus sp.
NKELPYWKSNGFLNNKKKPLRHVSKWKSIAE

SEQ ID NO: 3126 - protein, 1658 aa, synthetic construct
  source 1..1658: note = Description of Artificial Sequence: Synthetic polypeptide
  VARIANT 1383: note = Any amino acid
MPATSTWCQGPVPRIIGGSQEPAAFLSWGTLLCSGYGIIQHRDQQRLAGTPFFICRSLGTCQRAISSIIRTKMLLSGDVEENPGPSLRGMQWNCAGLSQGKRLALHKTLVDERIAFCLLSETRMTPGEAACFSVAGYQHHGIARNCKGGGVSILVREDLPVETGMAVVGRIEQVHATIHLARGTALTVTSAYIPPKHTFTATDLDTLLTTDGAQLIGADANAHALAWDRASPPNTKGETLTQWCIDNQFLVCNTGECTRYARHHGESTPDVTLSRNCTVYTWTSLYSPDSDHHHIFFDVIVGDDTDALSCPRLRKPMYAWLKADWRNFRLKVDELCRKIGREKNVNTLEQKLSSAIRIATKVSVPRGCRATPPHWTPELAKLDEEIAGCGPSHRREKLVATRKQILDRTTKKRWSTLCSRLAVSDRCSWHIVKKVYAPRPLTTPAVLVDNAAITDYRQAERFSKLYSSRARRHPDSHPPAPIKTIASEFSPITMAELRRSIKLLPSGSAAGPDCLYNEALQHLGRTALNVVLRLFNESLRTGVVPPAWKTGVIIPILKAGKKAEDLDSYRPVTLTSCLCKVMERIIAARLRDTVESQLTPQQSGFRPGCSTLEQLLHVRAALCRPTHQYRTGAVFVDYEKAFDTVDHDKIAREMHRMKVSPHIVKWCVSFLSNRTGRVRFKEKLSRSRTFERGVPQGTVLGPIMFIIVMNSLSQRLAEVPLLQHGFFADDLTLLARHTERDVINHTLQCGLNVVLQWSKEYFMSVNVAKTKCTLFGCIERHPLTLQLDGERIGADRTPKLLGVTFQCLQGMATHAAETRRKMDFRLLQIAAISASTWGPRRQVLRAFYLALVQAHTMYGIEVWYWDASERSRDLLAAAQHKASRIIAGIPHGTRKEDSLLEANLLPLKTTTLVRSMKFMLMCESRGGCLRRSAEEVYHSKHPVRALHSRIMRSYPHLRIEPREHPLETSTLRHSCRPLFHTQIKPVCADDPDDVKREASEKWIARHFARRGKEPPRREHYELWTDGSVSLGEKSGAAALLYRNNTLICAPKTGAGELSCSYRAECVALEIGLQRLLKWLPAYRSTPSRLSIFSDSLSMLTALQTGPLAVTDPILRRLWRLLLQVQRRKIRIRLQFVFGHCGVKRNEVCDEMAKKAADLPQLRDTWIPDIIAYAKRVLRSEEVHENTHRFGITGNHFPTKHKEELTREEETALARFRVGSSRHYGWMLRKINPSVPPQCRWCNPQHAAIGPTIQTAPTVATRTLQRTSEPTKCTECDATYQCRSSAVTHMVNKHGFVRADALRRIKYGDATPAVDIPPEPPPVVAIVPLPSSTRVPMRPQVLHCTLCASKFAVPGRLLHHLRTIHGIGSGSCRVKRGRENEDSXQGDGRAPAAPASQDTRKLPFQCDLCEASFGTRSSLSLHKKFKHKSIVTEDGTVVVVQFPRKRAREGNVDVPGKGEVQCGVCQKVLSCRDSLIRHCKAFHKGEGVELKCSKSTKLCATDSPHTNTSMLVCPTCGRQCASKTGLTLHQKKMHGMKVERAVTSQRGDCEETSLHLMSCPGLKELRVRFAVEGVCVQDVCFSKRLAQFLIAVERSRPQVKSSPKVTVIQPTLPSATSPLIAECGASRKSTGRRNSPDTLRDRGGMQSTSNRNRKKRGRE

SEQ ID NO: 3127 - protein, 975 aa, synthetic construct
  source 1..975: note = Description of Artificial Sequence: Synthetic polypeptide
MDVGTTKVQVYNRQTLLRYSNHAYLTIKDGLLHTLRDLGLLREPDLLTAVSPGANGGRRSTRKRCTRTRKRGKRAGVRARLRTNPSRPALPSILLSNVCSIENKMDYIRLQQTTQREFRDCCMFVFTETWLSERVPDAAIQLDGLVAVRADRVAALSGKNRGGGLCVYINTKWCRNSVLVSSHCSPLVEFVVVKCRPFYLPREIASIHIIGVYIPPSANTKDALWELYSAITDIQNTHPDGLIIIAGDFNHANLRSVLPKFHQHVEFATRGPNTLDQVYTNISSAYRAEPRPHFGYSDHISVMLIPAYRPLVRHSKPVLKQVKTWPAGAMTALQDCFECTDWNMFREAATYSDYINLDEYTSSVISYITKCIDDVTVSKCITTRLNQKPWFTGEVRVLLRARDSAFREGDEVALRTARAKLSRAIRVAKRAYTQRIHSFFQENGDTRRMWQGIQAITNYRSTPSACDSDASIADALNDFYARFEAQNNTGMRKTITLPSDQALRLTVADVRMTLERVNPRKAAGPDNIPGRVLRECADQLADVFTDIFNISLNTSTVPKCFKTTTIVPVPKKSSVSCLNDYRPVALTPIIMKCFEKLVKKHIKTLLPPALDPLQFAYRQNRSTDDAIATTLHLALSHLDKKDTYVRMLFIDFSSAFNTIIPQHLIEKLSLLGLNTSLCSWVLDFLTDRPQSVRIGNIISRTTTLSTGAPQGCVLSPLLFTLLTHDCAATHRTNHIIKFADDTTVVGLISNNDESPYREEVQRLTDWCRANNLSLNVDKTKEMVVDFRKTRSDHLPLYIDGSNVEIVKSTKFLGVHLAENLTWSHNTSYLAKKAQQRLYFLRKLRKSHLPPSILKTFYRGTIESILSSCITVWAGNCTVMERKTLQRIVKTAEKIIGVSLPSITDIYTTRCIRKATSIVADPTHPSHSLFTLLPSGKRYRSIRALTTRLCNSFFPQAIRLLNTQGPDRSLSHSHSI

SEQ ID NO: 3128 - protein, 1119 aa, synthetic construct
  source 1..1119: note = Description of Artificial Sequence: Synthetic polypeptide
MAKLIIFAVFACMVLPKVVTSFNRPIVCQYSIYISSSLLPSTYSSSYTLYNYLQHLCPPVTNKTRICRHFKSSSHIFSLFYLLLLAAGDISPNPGPCSIPTYIQPRFPANLRKSSRSSTFSNLIQIPTLPSSCLPFSCALLNTRSLTNKSTLIHDLFALIHLVFLHQKPGSHRMIPPLRLHSLMAVSLSLTPPEPLDVVGELEFSSRCRFKPIPIPPAFSFNSFEVHAIHIFHPLSVRVAVIYRPPSASSSAAFLSDFDTWLSFFLCTDSPAIILGDFNFHIDDASQPWPSRFLRLTSSFELQQWTNTPTHKDGHFLDLVFTKKLSLSGFNSEPFPLSDHNLVTFSISHSPCPPASSPTVLVRDTRDIDLPALAQSFRSSLISLKEMSDPDTLVSEYNHILSSTIGSFAPLQAKRTRALNPRPWLNSQTRFLRSCTRSAERMWKKSRTQADFIHYKFLLSCLNSALSKANKSTTVPLIHKPDSYAPVRDLLNVCGRNPVRKQTLFTINFYCPASILPCQKPTRVLQYPYKQSQIQPTTPVFSIQYFLHPSSTVSVNQTHSPQDFADFFKDKVESIRNQIPTSTNVNQLLLPKPPSACLNSFPPVTMSEVSKLLLSSPLTTCPLDPMPSSLLKHCVAELTPLLTHIFNSSLASGTFPSPFKQACVKPILKKATLDPACLSNYRPVSLLPLASKLLERIVFSRITNFLHTHDLLDPLQSGFRPGHSTETALCRVTNDLQVAKAKGHFSILLLLDLSSAFDTVDHSLLMQILYSLGIRNQAASWLSSYLSNRSFTVSYDNKTSSPVPLNVGVPQGSVLGPLLFSLYTLSLGDLIHSFGFNYHLYADDTQIYLSTPSLTAETEAQISNCLLAISNWMNQRHLKLNLTKTELIIFPPKPGPTPLFTISIDGMLINPVNSARCLGVIFDSSLSFSDHINTTVKTCHFFLRNIAKIRPFLSPDTSKTLMHALILSRLDYCNLLLTGLPNSHLSPLQSVLNTAARIILLSSKRVQAPPLLKSLSWLPIKQRITYKLLLITFKALHSSAPNYISSLVSLYVPARNLRSSQSNRLVVPPTTTAVSRIKPFSLATPYIWNAIPESLRRESSFNVFKTKLKDYLWEHLDNT

SEQ ID NO: 3129 - protein, 839 aa, synthetic construct
  source 1..839: note = Description of Artificial Sequence: Synthetic polypeptide
ILYIMTWMNENLHRHIATHFGENTLKLVREYERTARKLADYRNHLRFNLRCRYQGITPCSLRLGSSVKGHRAKVILQKAQKQLLNERVRQTNFSIEVLVHKFDNAKQRLTAKLPVLTLQRVVEFTERAQLAQHAKGKERQINKFTSLLSRTNNTQRTDKSTGRKEDENKTCQNIKDLWVKNLSDRELTEPEKDVLAKGLNFAVAPRYVPVVDFITATESSIHNNKIPVDEAENIRLKVSAALANAKAPPSNLSLQERRALTSLAKDSSVTILPADKGRCTVVLNTSDYHAKVSTLLNDSDTYEQLKRDPTSNYKKKVIDCLQHLEKEKVISPALYRRLYPGEATPCLYGLPKIHKEGAPLRPIVSSINCVTYNIAKYVANILAPLVGNTVHHIQNSMDFVKKVKELKLEIDDTMVSYDVTSLFTCIPTAEAIDTVRKRLKQDTTLSSRTKLTPEQVCSLLDLCLNTTYFKHKEVFYRQKHGCAMGSPVSPIVANLYMEEVEKKALDTFKGTTPSHWFRYVDDTWVKIKEREVPAFTKHINSVDKNITFTREDVKDSKLAFLDCAIVIKEGRDLDIEVYRKPTHTDQYLLFDSHHPLEHKLGVIRTLHHRAETVASNAEAKEKEYKHLKGALKTCGYPDWAFIKTKSKTNRKTRPTNRREEHSRRNNIVIPYVAGTSEKLRRIFNKHRIPVFFKPSNTLRQKLVHPKDPTPKHMKSNVVYAVQCSEECSDLYIGETKQPLCKRMAQHRRANSSGQDSAVYLHLKEKGHSFEDSNVHILDREDRWFERGVKEAIYASLEKPSLNRGGGLRHRLSPTYNGALTSLPRQFHNSSHFQSCTLKD

SEQ ID NO: 3130 - protein, 770 aa, synthetic construct
  source 1..770: note = Description of Artificial Sequence: Synthetic polypeptide
KGHRASNILQKAQKHLLNERVRQINFTIEALKQKIEQLKQSLTKQLPDVTLERVVQFIEHAQMAQHIKSKERQISKFTSLLSRSSGLKRTEELTWRQKDETSKNTKDTWVKNLSDRVLTQPEKDVLAKGLNYAVTPQHIPVVELITATESAINNNHIKVEEAEQLRLKVSAALSSARAPPSNLTTQERRALTSLSKDPNITILPADKGRCTVVLNTTDYHCKMTSLLSDSNTYEPLRRDPSSSYKKKVIDCLQQLEKEEAIDRALYHRLYPREATPCLYGLPKIHKDGAPLRPIVSSINSVTYSIAKYLANILAPLVGKTVHHIQNAKEFVTKIQGVKLEAEETMVSYDVTSLFTCIPTTEATETVRNRLQKDNTLSSRTKLSPNQVCLLLDLCLNTTYFKYKDQFYRQKHGCAMGSPVSPIVANLYMEEVERKALLTFNGTTPSHWFRYVDDTWVKIRSNEVAAFSEHINSVDNNIKFTREDVHENKLAFLDCLISIQEGGILKTEVYRKPTHTDQYLLFDSHHPLEHKLGVIRTLHHRAESVTTDTESKDKECKHLRGALKACGYPDWAFVKTRATKPNRNTKRNNRPEAERRRNIVIPYVAGVSEKLRRIFNKHHIPVFFKPSNTLRQKLVHPKDPTPKEKQSNVVYAVQCSEECTDLYIGETKQLLSKRMAQHRRANTTGQDSAVFLHLKDKGHSFENSNVQILDKEDRWFERGVKEAIHVKVEKPSLNRGGGLRHHLSATYNAVLTSVPRQFQNSSHIHSCNSNK

SEQ ID NO: 3131 - protein, 1067 aa, synthetic construct
  source 1..1067: note = Description of Artificial Sequence: Synthetic polypeptide
MSLLLLVLSFMFVLPKVTSSFSPPADCPYSITISSSLLHSTHCCSYNLYTFLKNLAPPTNTSQKHNNFKSFSHLLSLSLLLLLAAGDISPNPGPCRIPISYRPRNASLLVKPSQTANLSNLIQIPTLSSSYLPFSCALLNTRSVTNKAALIHDLFCSKSFHLFAITETWLSQNDNAIEAALSYGGLSFSHTPRITGRGGGVGVLLSPHCRFKLIPIPPTFRFPSFEVHAVQLFHPLSVRVAVVYRPPSSKSLATFLSDFESWLSFFLCSDTPAIILGDFNCHIDDPSQPWPSRFLHLTSSFDLRQWTNTATHKDGHFLDLVFSKNLDLSAFNSEPFPLSDHHLISFSISHVSPSPSTNAQPKTLIRNTQRVDITALSNSLSSSLSSFCASSDPELLVNTYNSILSSAINTHAPLQPQHSRAHNPRPWLNPQTRFLRSCARSAERIWRKSRVKADFLHYKFLMVCLNTALSQAKQVYYNTLVNNNKSNPRRLFSIFNALLHPSPNESIISEHTPQDFADFFKSKVDSIRKQFSQPSDTGNLNLPKSPLSVFSSFNLVTESEVSQLLRSSPPTTCSLDPMPSSLLKQCAPALTPALTHIFNSSLASGTFPSLFKQACVKPILKKATLDPSCLSNYRPVSLLPLASKLLERLVFSRVTNFLCTHNLLDPMQSGFRPAHSTETALCRVANDLQTAKAKGRYSVLILLDLSSAFDTVDHSVLMQILYSLGIRDQAASWFSSYLSNRSFSVALANKSSTPVPLSVGVPQGSVLGPLLFSLYTLSLGDLISSFGLKYHLYADDIQIYLDTPALTTDVQTQIGNCLLAISSWMNQRHLKLNLAKTELMVFPPKPGPSPPFTITIDGMTINPVNSARCLGVIFDQSLSFSNHINNTAKTCRFFLRNIAKIRPFLSQVTAKTLIHALILSRLDYCNLLLTGLPDSHLSPLQSILNSAARILLLSPKREPVQPHLSSLAWLPVKQRIAYKILLLTFKALHSSAPHYISSLVSLHVPGRLLRSSQSLRLFTPSTPTALSRLKPFYLAAPYLWNSIPESLRREHSPTLFKKKLSCYLLEH

SEQ ID NO: 3132 - protein, 1191 aa, synthetic construct
  source 1..1191: note = Description of Artificial Sequence: Synthetic polypeptide
MDPEKIIVWNVRGLNSLARQNSVRELLNCYGADIICLQETKMAQPSSRVLLSMLGSDFTGSLALPSNGSRGGILIAWRRHLGITGATRTDIHSISVQFCSVEGHQWWLTCVYGPQSNEAKIEFLQELRHIRAACQGPWMITGDFNLILHAEDKNNSHINRAMMGRFKKLVDDLALKEIPLHGRKFTWSNQQNQPTLVKLDRVLCSIDWEELFPGAVLQSAASEDSDHCPLLLGFKDCKGVKRRFHFESFWTKIEGFHEVVHNAWNSVPVGHCPFSTFDLKLKGTAKALQGWSSKKVGHIETQLHLARDLIHQLEIAQDGRILSVLERWLLSKLKKLALALASTKRTIARLRSRISWLKEGDANSKLFHSFARYRKKKNSVSKLTVGNQVLTAHSDIAAAVDQFYFDLIGASKDRNISINLEALETAGTPFPNLIELDSPITEQEVCNAINSLPSDKSPGPDGFTGRFYKICWSIIKEDLMAAVIAIWNRKFDNFHKLNSAFITLIPKKDNADQVKDFRPISLVHSFAKLITKILASRLASRLNDLVSPNQNAFIKGRFIQDNFMLVQQTAKLLHQQRHPCLMLKLDITKAFDSVSWPFLIEVMQNLGFGQIWRDIISGLLLTSSTRVLVNGHPGSIISHRRGLRQGDPLSPMLFVLVMDVLGQLVSKADEEGLLQPLSTRQLQHRVSLYADDVVLFINPVAEDMTMISDILQLFGEASGLYNNNQKSSVYPIRCHEDNLEIIQQFWPCEISSFPCKYLGLPLSLHKLRREQVQPIVDKIANQLPGWKADLLTKAGRSVLVQSVLTGVLIYSVMAVDLPSTTLKDIDKIRRGFLWRGRKNAMGGHCAVAWGSVCRPRELGGLGIFSITELSWALKMRWAWLQKTEPGRPWASLPLHTPKKIREFLQVALYSEIGNGASTLFWSDRWLDGQRIGDIAPRLIETIPMKLINKRTVQEAIEDNGWINDIPGSLSVGALADFLRIWDLVAHVDLDPHKEDKHIFRLAANGKYSTKAAYEGLFIGSVEFEPFERIWKTWAPPKCRFFLWLVAHKKCWTADRLEKRGLDHPEKCPLCEQERETIDHLLVNCVFSRECWFLLLRQFGLQGLAPQPTDINFMEWWHQANEAIQGSFRDGLNSLIMLGAWILWNHRNRCIFDGLSPNVANFLIHVGDERRLWETAGAKGLTSLVASLSHVA

SEQ ID NO: 3133 - protein, 838 aa, synthetic construct
  source 1..838: note = Description of Artificial Sequence: Synthetic polypeptide
MPLSESEKRKFWEDLDGMVRAVPTNEKLFIGGDLNGHVGSTNVGYELAHGGFGYGSRNQGEDILDFAVAYNLVIANTFFRKRDSHLVTFSSGHRSSQIDFVLTRREDKQACLDCKVIPGESVVPQHNLVVADFRFRIRTHRDKQAKIARTKWWKLKGETSEVFRERVFVEGAWSEEEDANNMWVKMATCIRKVASEVFGVTKGSIGEPKDTWWWTEDVQKAIKEKKECYRSLFHDRSAVNIERYKVAKKTAKRAVSEAKGRAYDDLYRRLSTKEGEKDVYKMARIRERKTRDLNQVKCIKDEMDQLLVKGQDIKQRWQRYFDNLFNGENETMDTQLDDSFDDLNRCFVRRIQESEVKEALKRMKGGKAMGPDGIPIEVWKCLGDIAIVWLTKLFNHIFRSNKMPDEWRRSTLVPIFKNKGDIQSCTNYRGIKLMSHTMKLWERVIEHRLRGMTHITMNQFGFMPGRSTMEAIFLIRQVMERYKEQKKDLHMVFIDLEKAYDKIPRNLMWWALDKHKVPTKYVTLIKDMYDKVVTSVRTTDGDTNVFPINIGLHQGSALSPYLFALVIDEVTRDIQGDIPWCMLFADDVVLVDESREGVNRKLELWRQTLESKGFRISRTKTEYMRCDFGTTISEDGDVSLGGQVVPKKDTFRYLGSMLQRDGDIDEDVSHRIKAGWMKWRQASGVLCDKRVPQKLKGKFYRTTIRPAMLYGAECWPTKRRHIQQLSVAEMRMLRWICGHTRLDRVRNDDIRDRLGVAPIEEKLIQHRLRWFGHVHRRPPEAPVHRGIIRRDNNVKRGRGRPNLTWEEAIKRDLKEWNIPMELCLDRSAWKEAIHVPEP

SEQ ID NO: 3134 - protein, 957 aa, synthetic construct
  source 1..957: note = Description of Artificial Sequence: Synthetic polypeptide
MTIVWQEGAGFILSPFGLSLRDFWRLFRWPGILFQLCSVLLQRLNSKLKATARGLQAWSAKKVGHISASLALARVLLHQLEIAQDSRGLSPAELWFLLCLKKHSLALSSLQRTIARLRSRIGWLREGDANTKLFHMHSRFRKKKNFVPKLVSNGAVLTSHDAKADLVNEFYGNLLGQCSDREQTISLESLGIPCHDLSALDAPFTEKEVWDTILHLPSDKAPGPDGFTGKFYRVCWEIIKADVMAVFSAVGSRRFANFQILNTAYITLIPKFEGADQVKNFRPISLVHSVAKLLTKLLANRLAGRLHDMVSPNQSAFIKGRFIQDNYMLVQQTTRYLHQQKQPRMLLKLDISKAFDSVSWPFLLEVLQHLGFGQVWRDIISGLLWTSSSQVLLNGLPGQPILHRRGLRQGDPLSPFLFILVMDTLGFLINKAAQDGLLQPLAPRALQHRVSLYADDVVIFLRPAAMDINVILDCLQLFGDASGLRTNVQKSSVYPIRCGDQDLALLQNMLPCELAEFPCRYLGLPLAIKKLSKIQVQPIIDKIANQLSGWKAELLTKAGRKVHVQHVLTGMVIYLAMAVDLPAWALKAIDKIRRGFLWRGRRDVKGGHCHVAWGIVCRPRELGGLGISSMKELAWSLRMRWLWLAKTEPSRPWASLAIQVPKKVKDFFSMAMQTELGNGATTFFWTDRWLSGHRIAELVPRLFGIIPKRRVSKRTVVDAISNQSWISDIQGALSVGIINEFLILWDLIDSIVLRPQVEDKHFFRLAANGKFSSKEAYRGFFLGSSEFEPFHRIWKSWAPPKTKFFMWLVAHRKVWTADRLQKRGMDHPERCPLCDQDQETLDHMLIGCVFAREFWFKLLLQVNLQFLAPQSEDSAFLEWWRTLCTKVSGIARDGLNSLVILGVWTLWKQRNGCVFDNKSPSIADAIRRVELEVHLWEMAGAKKLSLLTAPIPGIPAS

SEQ ID NO: 3135 - protein, 801 aa, synthetic construct
  source 1..801: note = Description of Artificial Sequence: Synthetic polypeptide
  VARIANT 526: note = Any amino acid
  VARIANT 619: note = Any amino acid
  VARIANT 795: note = Any amino acid
MAKKKRRKAPWAEAPSSPRAPAPVAHGPGGVRSGLVGLPSTVGFAAQGKCAPAPFASSVSWTGWSQGISPLAPTLAHSSRVLLPAATSDAAVSKSRLGFPPDFVGSHSFPHCAAFLSRLWSLPVSSRSDFHGGWCVTSLRPPVPEEEWPRLGSGVVRSSKNLGEMDPKNKNIPNPSWDRWGQKDSAQGSQSWNRNRNLSWRLKPQIGKSDPQEGLMSSSSGDGIQSGNPILSPSSLKKEIDLARPAFCQKCGVEGHHARNCFNALWCDICRKDTHVTARCVLPKQSKPNMPIVGMAADGLGFYLSHFAKPISKKPKRVFIGLVKVIEGLVSAEDLAKDFGFHFPWGKTWKATKCHSGFLMQFPSQERLDEMISFPELKMKMSGAKIVVVPWSSRAKPKSRLHTAWIVAENVPEELQNYQSICEIGSMIGAVEEVDLMSLDSEDIVRFKVHIKSVAMIPPVVEVAVKPFLYDIYFRIESISDEGWNDETINLGKRASVDIHGINDPVFDKSGKKPRNDDEVGDEDPXPNFKVGESSSQGKESFKKSEVFMDSSKDKSGDGMRLEDLSDEKVDFDPNEDDLLSSQELEEFAKDMEEMHTDFQAKVGEVLSIPLTKDEKQDXVGKKSSEILMSTSEGIRKSSRLEKNEDIKVADKAISRAEAKDAFLNKGMNNNPFSLLNASNEDLFDISNKLGVCLGSSDSSAMANLDLIRDLEMSRKILAIQSCGSKKNEEPIVDDINEVDSSVHADSEKDIDYDLLDVMVLRKGRKIKHRKKQQKKASPKIRYTPNKKREAENFXLPPDPF

SEQ ID NO: 3136 - protein, 673 aa, synthetic construct
  source 1..673: note = Description of Artificial Sequence: Synthetic polypeptide
TAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFDEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGTIGYCRLWIPGFAELAQPLYAATRGGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGLLTAGGKAIKNAPEILALLTAVWLPKRVAVMHCKGHQKDDAPTSTGNRRADEVAREVAIRPLSTQATIS

SEQ ID NO: 3137 - protein, 673 aa, synthetic construct
  source 1..673: note = Description of Artificial Sequence: Synthetic polypeptide
TAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFNEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGTIGYCRLWIPGFAELAQPLYAATRPGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGWLTAGGKAIKNAPEILALLTAVWLPKRVAVMHCKGHQKDDAPTSTGNRRADEVAREVAIRPLSTQATIS

SEQ ID NO: 3138 - protein, 673 aa, synthetic construct
  source 1..673: note = Description of Artificial Sequence: Synthetic polypeptide
TAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFNEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGKIGYCRLFIPGFAELAQPLYAATRPGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGWLTAGGKAIKNAPEILALLTAVWLPKRVAVMHCKGHQKDDAPTSTGNRRADEVAREVAIRPLSTQATIS

SEQ ID NO: 3139 - protein, 677 aa, synthetic construct
  source 1..677: note = Description of Artificial Sequence: Synthetic polypeptide
TVSLQDEHRLFDIPVTTSLPDVWLQDFPQAWAETGGLGRAKCQAPIIIDLKPTAVPVSIKQYPMSLEAHMGIRQHIIKFLELGVLRPCRSPWNTPLLPVKKPGTQDYRPVQDLREINKRTVDIHPTVPNPYNLLSTLKPDYSWYTVLDLKDAFFCLPLAPQSQELFAFEWKDPERGISGQLTWTRLPQGFKNSPTLFDEALHRDLTDFRTQHPEVTLLQYVDDLLLAAPTKKACTQGTRHLLQELGEKGYRASAKKAQICQTKVTYLGYILSEGKRWLTPGRIETVARIPPPRNPREVREFLGTAGFCRLWIPGFAELAAPLYALTKESTPFTWQTEHQLAFEALKKALLSAPALGLPDTSKPFTLFLDERQGIAKGVLTQKLGPWKRPVAYLSKKLDPVAAGWPPCLRIMAATAMLVKDSAKLTLGQPLTVITPHTLEAIVRQPPDRWITNARLTHYQALLLDTDRVQFGPPVTLNPATLLPVPENQPSPHDCRQVLAETHGTREDLKDQELPDADHTWYTDGSSYLDSGTRRAGAAVVDGHNTIWAQSLPPGTSAQKAELIALTKALELSKGKKANIYTDSRYAFATAHTHGSIYERRGLLTSEGKEIKNKAEIIALLKALFLPQEVAIIHCPGHQKGQDPVAVGNRQADRVARQAAMAEVLTLATEPDNTSHIT

SEQ ID NO: 3140 - protein, 677 aa, synthetic construct
  source 1..677: note = Description of Artificial Sequence: Synthetic polypeptide
TVSLQDEHRLFDIPVTTSLPDVWLQDFPQAWAETGGLGRAKCQAPIIIDLKPTAVPVSIKQYPMSLEAHMGIRQHIIKFLELGVLRPCRSPWNTPLLPVKKPGTQDYRPVQDLREINKRTVDIHPTVPNPYNLLSTLKPDYSWYTVLDLKDAFFCLPLAPQSQELFAFEWKDPERGISGQLTWTRLPQGFKNSPTLFNEALHRDLTDFRTQHPEVTLLQYVDDLLLAAPTKKACTQGTRHLLQELGEKGYRASAKKAQICQTKVTYLGYILSEGKRWLTPGRIETVARIPPPRNPREVREFLGTAGFCRLWIPGFAELAAPLYALTKPSTPFTWQTEHQLAFEALKKALLSAPALGLPDTSKPFTLFLDERQGIAKGVLTQKLGPWKRPVAYLSKKLDPVAAGWPPCLRIMAATAMLVKDSAKLTLGQPLTVITPHTLEAIVRQPPDRWITNARLTHYQALLLDTDRVQFGPPVTLNPATLLPVPENQPSPHDCRQVLAETHGTREDLKDQELPDADHTWYTDGSSYLDSGTRRAGAAVVDGHNTIWAQSLPPGTSAQKAELIALTKALELSKGKKANIYTDSRYAFATAHTHGSIYERRGWLTSEGKEIKNKAEIIALLKALFLPQEVAIIHCPGHQKGQDPVAVGNRQADRVARQAAMAEVLTLATEPDNTSHIT

SEQ ID NO: 3141 - protein, 677 aa, synthetic construct
  source 1..677: note = Description of Artificial Sequence: Synthetic polypeptide
TVSLQDEHRLFDIPVTTSLPDVWLQDFPQAWAETGGLGRAKCQAPIIIDLKPTAVPVSIKQYPMSLEAHMGIRQHIIKFLELGVLRPCRSPWNTPLLPVKKPGTQDYRPVQDLREINKRTVDIHPTVPNPYNLLSTLKPDYSWYTVLDLKDAFFCLPLAPQSQELFAFEWKDPERGISGQLTWTRLPQGFKNSPTLFNEALHRDLTDFRTQHPEVTLLQYVDDLLLAAPTKKACTQGTRHLLQELGEKGYRASAKKAQICQTKVTYLGYILSEGKRWLTPGRIETVARIPPPRNPREVREFLGKAGFCRLFIPGFAELAAPLYALTKPSTPFTWQTEHQLAFEALKKALLSAPALGLPDTSKPFTLFLDERQGIAKGVLTQKLGPWKRPVAYLSKKLDPVAAGWPPCLRIMAATAMLVKDSAKLTLGQPLTVITPHTLEAIVRQPPDRWITNARLTHYQALLLDTDRVQFGPPVTLNPATLLPVPENQPSPHDCRQVLAETHGTREDLKDQELPDADHTWYTDGSSYLDSGTRRAGAAVVDGHNTIWAQSLPPGTSAQKAELIALTKALELSKGKKANIYTDSRYAFATAHTHGSIYERRGWLTSEGKEIKNKAEIIALLKALFLPQEVAIIHCPGHQKGQDPVAVGNRQADRVARQAAMAEVLTLATEPDNTSHIT

SEQ ID NO: 3142 - protein, 576 aa, synthetic construct
  source 1..576: note = Description of Artificial Sequence: Synthetic polypeptide
GVLDAPPSHIGLEHLPPPPEVPQFPLNLERLQALQDLVHRSLEAGYISPWDGPGNNPVFPVRKPNGAWRFVHDLRVTNALTKPIPALSPGPPDLTAIPTHLPHIICLDLKDAFFQIPVEDRFRSYFAFTLPTPGGLQPHRRFAWRVLPQGFINSPALFERALQEPLRQVSAAFSQSLLVSYMDDILYVSPTEEQRLQCYQTMAAHLRDLGFQVASEKTRQTPSPVPFLGQMVHERMVTYQSLPTLQISSPISLHQLQTVLGDLQWVSRGTPTTRRPLQLLYSSLKGIDDPRAIIHLSPEQQQGIAELRQALSHNARSRYNEQEPLLAYVHLTRAGSTLVLFQKGAQFPLAYFQTPLTDNQASPWGLLLLLGCQYLQAQALSSYAKTILKYYHNLPKTSLDNWIQSSEDPRVQELLQLWPQISSQGIQPPGPWKTLVTRAEVFLTPQFSPEPIPAALCLFSDGAARRGAYCLWKDHLLDFQAVPAPESAQKGELAGLLAGLAAAPPEPLNIWVDSKYLYSLLRTLVLGAWLQPDPVPSYALLYKSLLRHPAIFVGHVRSHSSASHPIASLNNYVDQL

SEQ ID NO: 3143 - protein, 576 aa, synthetic construct
  source 1..576: note = Description of Artificial Sequence: Synthetic polypeptide
GVLDAPPSHIGLEHLPPPPEVPQFPLNLERLQALQDLVHRSLEAGYISPWDGPGNNPVFPVRKPNGAWRFVHDLRVTNALTKPIPALSPGPPDLTAIPTHLPHIICLDLKDAFFQIPVEDRFRSYFAFTLPTPGGLQPHRRFAWRVLPQGFINSPALFQRALQEPLRQVSAAFSQSLLVSYMDDILYVSPTEEQRLQCYQTMAAHLRDLGFQVASEKTRQTPSPVPFLGQMVHERMVTYQSLPTLQISSPISLHQLQTVLGDLQWVSRGTPTTRRPLQLLYSSLKPIDDPRAIIHLSPEQQQGIAELRQALSHNARSRYNEQEPLLAYVHLTRAGSTLVLFQKGAQFPLAYFQTPLTDNQASPWGLLLLLGCQYLQAQALSSYAKTILKYYHNLPKTSLDNWIQSSEDPRVQELLQLWPQISSQGIQPPGPWKTLVTRAEVFLTPQFSPEPIPAALCLFSDGAARRGAYCLWKDHLLDFQAVPAPESAQKGELAGLLAGLAAAPPEPLNIWVDSKYLYSLLRTLVLGAWLQPDPVPSYALLYKSLLRHPAIFVGHVRSHSSASHPIASLNNYVDQL

SEQ ID NO: 3144 - protein, 576 aa, synthetic construct
  source 1..576: note = Description of Artificial Sequence: Synthetic polypeptide
GVLDAPPSHIGLEHLPPPPEVPQFPLNLERLQALQDLVHRSLEAGYISPWDGPGNNPVFPVRKPNGAWRFVHDLRVTNALTKPIPALSPGPPDLTAPPTHLPHIICLDLKDAFFQIPVEDRFRSYFAFTLPTPGGLQPHRRFAWRVLPQGFINSPALFQRALQEPLRQVSAAFSQSLLVSYMDDILYVSPTEEQRLQCYQTMAAHLRDLGFQVASEKTRQTPSPVPFLGQMVHERMVTYQSLPTLQISSPISLHQLQTVLGDLQWVSRGTPTTRRPLQLLYSSLKPIDDPRAIIHLSPEQQQGIAELRQALSHNARSRYNEQEPLLAYVHLTRAGSTLVLFQKGAQFPLAYFQTPLTDNQASPWGLLLLLGCQYLQAQALSSYAKTILKYYHNLPKTSLDNWIQSSEDPRVQELLQLWPQISSQGIQPPGPWKTLVTRAEVFLTPQFSPEPIPAALCLFSDGAARRGAYCLWKDHLLDFQAVPAPESAQKGELAGLLAGLAAAPPEPLNIWVDSKYLYSLLRTLVLGAWLQPDPVPSYALLYKSLLRHPAIFVGHVRSHSSASHPIASLNNYVDQL

SEQ ID NO: 3145 - protein, 576 aa, synthetic construct
  source 1..576: note = Description of Artificial Sequence: Synthetic polypeptide
GVLDTPPSHIGLEHLPPPPEVPQFPLNLERLQALQDLVHRSLEAGYISPWDGPGNNPVFPVRKPNGAWRFVHDLRATNALTKPIPALSPGPPDLTAIPTHPPHIICLDLKDAFFQIPVEDRFRFYLSFTLPSPGGLQPHRRFAWRVLPQGFINSPALFERALQEPLRQVSAAFSQSLLVSYMDDILYASPTEEQRSQCYQALAARLRDLGFQVASEKTSQTPSPVPFLGQMVHEQIVTYQSLPTLQISSPISLHQLQAVLGDLQWVSRGTPTTRRPLQLLYSSLKRHHDPRAIIQLSPEQLQGIAELRQALSHNARSRYNEQEPLLAYVHLTRAGSTLVLFQKGAQFPLAYFQTPLTDNQASPWGLLLLLGCQYLQTQALSSYAKPILKYYHNLPKTSLDNWIQSSEDPRVQELLQLWPQISSQGIQPPGPWKTLITRAEVFLTPQFSPDPIPAALCLFSDGATGRGAYCLWKDHLLDFQAVPAPESAQKGELAGLLAGLAAAPPEPVNIWVDSKYLYSLLRTLVLGAWLQPDPVPSYALLYKSLLRHPAIVVGHVRSHSSASHPIASLNNYVDQL

SEQ ID NO: 3146 - protein, 576 aa, synthetic construct
  source 1..576: note = Description of Artificial Sequence: Synthetic polypeptide
GVLDTPPSHIGLEHLPPPPEVPQFPLNLERLQALQDLVHRSLEAGYISPWDGPGNNPVFPVRKPNGAWRFVHDLRATNALTKPIPALSPGPPDLTAIPTHPPHIICLDLKDAFFQIPVEDRFRFYLSFTLPSPGGLQPHRRFAWRVLPQGFINSPALFNRALQEPLRQVSAAFSQSLLVSYMDDILYASPTEEQRSQCYQALAARLRDLGFQVASEKTSQTPSPVPFLGQMVHEQIVTYQSLPTLQISSPISLHQLQAVLGDLQWVSRGTPTTRRPLQLLYSSLKRHHDPRAIIQLSPEQLQGIAELRQALSHNARSRYNEQEPLLAYVHLTRAGSTLVLFQKGAQFPLAYFQTPLTDNQASPWGLLLLLGCQYLQTQALSSYAKPILKYYHNLPKTSLDNWIQSSEDPRVQELLQLWPQISSQGIQPPGPWKTLITRAEVFLTPQFSPDPIPAALCLFSDGATGRGAYCLWKDHLLDFQAVPAPESAQKGELAGLLAGLAAAPPEPVNIWVDSKYLYSLLRTWVLGAWLQPDPVPSYALLYKSLLRHPAIVVGHVRSHSSASHPIASLNNYVDQL

SEQ ID NO: 3147 - protein, 576 aa, synthetic construct
  source 1..576: note = Description of Artificial Sequence: Synthetic polypeptide
GVLDTPPSHIGLEHLPPPPEVPQFPLNLERLQALQDLVHRSLEAGYISPWDGPGNNPVFPVRKPNGAWRFVHDLRATNALTKPIPALSPGPPDLTAPPTHPPHIICLDLKDAFFQIPVEDRFRFYLSFTLPSPGGLQPHRRFAWRVLPQGFINSPALFQRALQEPLRQVSAAFSQSLLVSYMDDILYASPTEEQRSQCYQALAARLRDLGFQVASEKTSQTPSPVPFLGQMVHEQIVTYQSLPTLQISSPISLHQLQAVLGDLQWVSRGTPTTRRPLQLLYSSLKRHHDPRAIIQLSPEQLQGIAELRQALSHNARSRYNEQEPLLAYVHLTRAGSTLVLFQKGAQFPLAYFQTPLTDNQASPWGLLLLLGCQYLQTQALSSYAKPILKYYHNLPKTSLDNWIQSSEDPRVQELLQLWPQISSQGIQPPGPWKTLITRAEVFLTPQFSPDPIPAALCLFSDGATGRGAYCLWKDHLLDFQAVPAPESAQKGELAGLLAGLAAAPPEPVNIWVDSKYLYSLLRTWVLGAWLQPDPVPSYALLYKSLLRHPAIVVGHVRSHSSASHPIASLNNYVDQL

SEQ ID NO: 3148 - protein, 748 aa, synthetic construct
  source 1..748: note = Description of Artificial Sequence: Synthetic polypeptide
MDLLKPLTVERKGVKIKGYWNSQADITCVPKDLLQGEEPVRQQNVTTIHGTQEGDVYYVNLKIDGRRINTEVIGTTLDYAIITPGDVPWILKKPLELTIKLDLEEQQGTLLNNSILSKKGKEELKQLFEKYSALWQSWENQVGHRRIRPHKIATGTVKPTPQKQYHINPKAKPDIQIVINDLLKQGVLIQKESTMNTPVYPVPKPNGRWRMVLDYRAVNKVTPLIAVQNQHSYGILGSLFKGRYKTTIDLSNGFWAHPIVPEDYWITAFTWQGKQYCWTVLPQGFLNSPGLFTGDVVDLLQGIPNVEVYVDDVYISHDSEKEHLEYLDILFNRLKEAGYIISLKKSNIANSIVDFLGFQITNEGRGLTDTFKEKLENITAPTTLKQLQSILGLLNFARNFIPDFTELIAPLYALIPKSTKNYVPWQIEHSTTLETLITKLNGAEYLQGRKGDKTLIMKVNASYTTGYIRYYNEGEKKPISYVSIVFSKTELKFTELEKLLTTVHKGLLKALDLSMGQNIHVYSPIVSMQNIQKTPQTAKKALASRWLSWLSYLEDPRIRFFYDPQMPALKDLPAVDTGKDNKKHPSNFQHIFYTDGSAITSPTKEGHLNAGMGIVYFINKDGNLQKQQEWSISLGNHTAQFAEIAAFEFALKKCLPLGGNILVVTDSNYVAKAYNEELDVWASNGFVNNRKKPLKHISKWKSVADLKRLRPDVVVTHEPGHQKLDSSPHAYGNNLADQLATQASFKVH

SEQ ID NO: 3149 - protein, 662 aa, synthetic construct
  source 1..662: note = Description of Artificial Sequence: Synthetic polypeptide
VPWILKKPLELTIKLDLEEQQGTLLNNSILSKKGKEELKQLFEKYSALWQSWENQVGHRRIRPHKIATGTVKPTPQKQYHINPKAKPDIQIVINDLLKQGVLIQKESTMNTPVYPVPKPNGRWRMVLDYRAVNKVTPLIAVQNQHSYGILGSLFKGRYKTTIDLSNGFWAHPIVPEDYWITAFTWQGKQYCWTVLPQGFLNSPGLFTGDVVDLLQGIPNVEVYVDDVYISHDSEKEHLEYLDILFNRLKEAGYIISLKKSNIANSIVDFLGFQITNEGRGLTDTFKEKLENITAPTTLKQLQSILGLLNFARNFIPDFTELIAPLYALIPKSTKNYVPWQIEHSTTLETLITKLNGAEYLQGRKGDKTLIMKVNASYTTGYIRYYNEGEKKPISYVSIVFSKTELKFTELEKLLTTVHKGLLKALDLSMGQNIHVYSPIVSMQNIQKTPQTAKKALASRWLSWLSYLEDPRIRFFYDPQMPALKDLPAVDTGKDNKKHPSNFQHIFYTDGSAITSPTKEGHLNAGMGIVYFINKDGNLQKQQEWSISLGNHTAQFAEIAAFEFALKKCLPLGGNILVVTDSNYVAKAYNEELDVWASNGFVNNRKKPLKHISKWKSVADLKRLRPDVVVTHEPGHQKLDSSPHAYGNNLADQLATQASFKVH

SEQ ID NO: 3150 - protein, 662 aa, synthetic construct
  source 1..662: note = Description of Artificial Sequence: Synthetic polypeptide
VPWILKKPLELTIKLDLEEQQGTLLNNSILSKKGKEELKQLFEKYSALWQSWENQVGHRRIRPHKIATGTVKPTPQKQYHINPKAKPDIQIVINDLLKQGVLIQKESTMNTPVYPVPKPNGRWRMVLDYRAVNKVTPLIAVQNQHSYGILGSLFKGRYKTTIDLSNGFWAHPIVPEDYWITAFTWQGKQYCWTVLPQGFLNSPGLFNGDVVDLLQGIPNVEVYVDDVYISHDSEKEHLEYLDILFNRLKEAGYIISLKKSNIANSIVDFLGFQITNEGRGLTDTFKEKLENITAPTTLKQLQSILGLLNFARNFIPDFTELIAPLYALIPKSPKNYVPWQIEHSTTLETLITKLNGAEYLQGRKGDKTLIMKVNASYTTGYIRYYNEGEKKPISYVSIVFSKTELKFTELEKLLTTVHKGLLKALDLSMGQNIHVYSPIVSMQNIQKTPQTAKKALASRWLSWLSYLEDPRIRFFYDPQMPALKDLPAVDTGKDNKKHPSNFQHIFYTDGSAITSPTKEGHLNAGMGIVYFINKDGNLQKQQEWSISLGNHTAQFAEIAAFEFALKKCLPLGGNILVVTDSNYVAKAYNEELDVWASNGFVNNRKKPLKHISKWKSVADLKRLRPDVVVTHEPGHQKLDSSPHAYGNNLADQLATQASFKVH

SEQ ID NO: 3151 - protein, 662 aa, synthetic construct
  source 1..662: note = Description of Artificial Sequence: Synthetic polypeptide
VPWILKKPLELTIKLDLEEQQGTLLNNSILSKKGKEELKQLFEKYSALWQSWENQVGHRRIRPHKIATGTVKPTPQKQYHINPKAKPDIQIVINDLLKQGVLIQKESTMNTPVYPVPKPNGRWRMVLDYRAVNKVTPLIAVQNQHSYGILGSLFKGRYKTTIDLSNGFWAHPIVPEDYWITAFTWQGKQYCWTVLPQGFLNSPGLFNGDVVDLLQGIPNVEVYVDDVYISHDSEKEHLEYLDILFNRLKEAGYIISLKKSNIANSIVDFLGFQITNEGRGLTDTFKEKLENITAPTTLKQLQSILGKLNFARNFIPDFTELIAPLYALIPKSPKNYVPWQIEHSTTLETLITKLNGAEYLQGRKGDKTLIMKVNASYTTGYIRYYNEGEKKPISYVSIVFSKTELKFTELEKLLTTVHKGLLKALDLSMGQNIHVYSPIVSMQNIQKTPQTAKKALASRWLSWLSYLEDPRIRFFYDPQMPALKDLPAVDTGKDNKKHPSNFQHIFYTDGSAITSPTKEGHLNAGMGIVYFINKDGNLQKQQEWSISLGNHTAQFAEIAAFEFALKKCLPLGGNILVVTDSNYVAKAYNEELDVWASNGFVNNRKKPLKHISKWKSVADLKRLRPDVVVTHEPGHQKLDSSPHAYGNNLADQLATQASFKVH

SEQ ID NO: 3152 - protein, 748 aa, synthetic construct
  source 1..748: note = Description of Artificial Sequence: Synthetic polypeptide
MDLLKPLTVERKGVKIKGYWNSQADITCVPKDLLQGEEPVRQQNVTTIHGTQEGDVYYVNLKIDGRRINTEVIGTTLDYAIITPGDVPWILKKPLELTIKLDLEEQQGTLLNNSILSKKGKEELKQLFEKYSALWQSWENQVGHRRIRPHKIATGTVKPTPQKQYHINPKAKPDIQIVINDLLKQGVLIQKESTMNTPVYPVPKPNGRWRMVLDYRAVNKVTPLIAVQNQHSYGILGSLFKGRYKTTIDLSNGFWAHPIVPEDYWITAFTWQGKQYCWTVLPQGFLNSPGLFNGDVVDLLQGIPNVEVYVDDVYISHDSEKEHLEYLDILFNRLKEAGYIISLKKSNIANSIVDFLGFQITNEGRGLTDTFKEKLENITAPTTLKQLQSILGLLNFARNFIPDFTELIAPLYALIPKSPKNYVPWQIEHSTTLETLITKLNGAEYLQGRKGDKTLIMKVNASYTTGYIRYYNEGEKKPISYVSIVFSKTELKFTELEKLLTTVHKGLLKALDLSMGQNIHVYSPIVSMQNIQKTPQTAKKALASRWLSWLSYLEDPRIRFFYDPQMPALKDLPAVDTGKDNKKHPSNFQHIFYTDGSAITSPTKEGHLNAGMGIVYFINKDGNLQKQQEWSISLGNHTAQFAEIAAFEFALKKCLPLGGNILVVTDSNYVAKAYNEELDVWASNGFVNNRKKPLKHISKWKSVADLKRLRPDVVVTHEPGHQKLDSSPHAYGNNLADQLATQASFKVH

SEQ ID NO: 3153 - protein, 748 aa, synthetic construct
  source 1..748: note = Description of Artificial Sequence: Synthetic polypeptide
MDLLKPLTVERKGVKIKGYWNSQADITCVPKDLLQGEEPVRQQNVTTIHGTQEGDVYYVNLKIDGRRINTEVIGTTLDYAIITPGDVPWILKKPLELTIKLDLEEQQGTLLNNSILSKKGKEELKQLFEKYSALWQSWENQVGHRRIRPHKIATGTVKPTPQKQYHINPKAKPDIQIVINDLLKQGVLIQKESTMNTPVYPVPKPNGRWRMVLDYRAVNKVTPLIAVQNQHSYGILGSLFKGRYKTTIDLSNGFWAHPIVPEDYWITAFTWQGKQYCWTVLPQGFLNSPGLFNGDVVDLLQGIPNVEVYVDDVYISHDSEKEHLEYLDILFNRLKEAGYIISLKKSNIANSIVDFLGFQITNEGRGLTDTFKEKLENITAPTTLKQLQSILGKLNFARNFIPDFTELIAPLYALIPKSPKNYVPWQIEHSTTLETLITKLNGAEYLQGRKGDKTLIMKVNASYTTGYIRYYNEGEKKPISYVSIVFSKTELKFTELEKLLTTVHKGLLKALDLSMGQNIHVYSPIVSMQNIQKTPQTAKKALASRWLSWLSYLEDPRIRFFYDPQMPALKDLPAVDTGKDNKKHPSNFQHIFYTDGSAITSPTKEGHLNAGMGIVYFINKDGNLQKQQEWSISLGNHTAQFAEIAAFEFALKKCLPLGGNILVVTDSNYVAKAYNEELDVWASNGFVNNRKKPLKHISKWKSVADLKRLRPDVVVTHEPGHQKLDSSPHAYGNNLADQLATQASFKVH

SEQ ID NO: 3154 - protein, 670 aa, synthetic construct
  source 1..670: note = Description of Artificial Sequence: Synthetic polypeptide
TLQLEEEYRLFEPESTQKQEMDIWLKNFPQAWAETGGMGTAHCQAPVLIQLKATATPISIRQYPMPHEAYQGIKPHIRRMLDQGILKPCQSPWNTPLLPVKKPGTEDYRPVQDLREVNKRVEDIHPTVPNPYNLLSTLPPSHPWYTVLDLKDAFFCLRLHSESQLLFAFEWRDPEIGLSGQLTWTRLPQGFKNSPTLFDEALHSDLADFRVRYPALVLLQYVDDLLLAAATRTECLEGTKALLETLGNKGYRASAKKAQICLQEVTYLGYSLKDGQRWLTKARKEAILSIPVPKNSRQVREFLGTAGYCRLWIPGFAELAAPLYPLTRPGTLFQWGTEQQLAFEDIKKALLSSPALGLPDITKPFELFIDENSGFAKGVLVQKLGPWKRPVAYLSKKLDTVASGWPPCLRMVAAIAILVKDAGKLTLGQPLTILTSHPVEALVRQPPNKWLSNARMTHYQAMLLDAERVHFGPTVSLNPATLLPLPSGGNHHDCLQILAETHGTRPDLTDQPLPDADLTWYTDGSSFIRNGEREAGAAVTTESEVIWAAPLPPGTSAQRAELIALTQALKMAEGKKLTVYTDSRYAFATTHVHGEIYRRRGLLTSEGKEIKNKNEILALLEALFLPKRLSIIHCPGHQKGDSPQAKGNRLADDTAKKAATETHSSLTVLP

SEQ ID NO: 3155 - protein, 670 aa, synthetic construct
  source 1..670: note = Description of Artificial Sequence: Synthetic polypeptide
TLQLEEEYRLFEPESTQKQEMDIWLKNFPQAWAETGGMGTAHCQAPVLIQLKATATPISIRQYPMPHEAYQGIKPHIRRMLDQGILKPCQSPWNTPLLPVKKPGTEDYRPVQDLREVNKRVEDIHPTVPNPYNLLSTLPPSHPWYTVLDLKDAFFCLRLHSESQLLFAFEWRDPEIGLSGQLTWTRLPQGFKNSPTLFNEALHSDLADFRVRYPALVLLQYVDDLLLAAATRTECLEGTKALLETLGNKGYRASAKKAQICLQEVTYLGYSLKDGQRWLTKARKEAILSIPVPKNSRQVREFLGTAGYCRLWIPGFAELAAPLYPLTRPGTLFQWGTEQQLAFEDIKKALLSSPALGLPDITKPFELFIDENSGFAKGVLVQKLGPWKRPVAYLSKKLDTVASGWPPCLRMVAAIAILVKDAGKLTLGQPLTILTSHPVEALVRQPPNKWLSNARMTHYQAMLLDAERVHFGPTVSLNPATLLPLPSGGNHHDCLQILAETHGTRPDLTDQPLPDADLTWYTDGSSFIRNGEREAGAAVTTESEVIWAAPLPPGTSAQRAELIALTQALKMAEGKKLTVYTDSRYAFATTHVHGEIYRRRGWLTSEGKEIKNKNEILALLEALFLPKRLSIIHCPGHQKGDSPQAKGNRLADDTAKKAATETHSSLTVLP

SEQ ID NO: 3156 - protein, 670 aa, synthetic construct
  source 1..670: note = Description of Artificial Sequence: Synthetic polypeptide
TLQLEEEYRLFEPESTQKQEMDIWLKNFPQAWAETGGMGTAHCQAPVLIQLKATATPISIRQYPMPHEAYQGIKPHIRRMLDQGILKPCQSPWNTPLLPVKKPGTEDYRPVQDLREVNKRVEDIHPTVPNPYNLLSTLPPSHPWYTVLDLKDAFFCLRLHSESQLLFAFEWRDPEIGLSGQLTWTRLPQGFKNSPTLFNEALHSDLADFRVRYPALVLLQYVDDLLLAAATRTECLEGTKALLETLGNKGYRASAKKAQICLQEVTYLGYSLKDGQRWLTKARKEAILSIPVPKNSRQVREFLGKAGYCRLFIPGFAELAAPLYPLTRPGTLFQWGTEQQLAFEDIKKALLSSPALGLPDITKPFELFIDENSGFAKGVLVQKLGPWKRPVAYLSKKLDTVASGWPPCLRMVAAIAILVKDAGKLTLGQPLTILTSHPVEALVRQPPNKWLSNARMTHYQAMLLDAERVHFGPTVSLNPATLLPLPSGGNHHDCLQILAETHGTRPDLTDQPLPDADLTWYTDGSSFIRNGEREAGAAVTTESEVIWAAPLPPGTSAQRAELIALTQALKMAEGKKLTVYTDSRYAFATTHVHGEIYRRRGWLTSEGKEIKNKNEILALLEALFLPKRLSIIHCPGHQKGDSPQAKGNRLADDTAKKAATETHSSLTVLP

SEQ ID NO: 3157 - protein, 751 aa, synthetic construct
  source 1..751: note = Description of Artificial Sequence: Synthetic polypeptide
MNPLQLLQPLPAEIKGTKLLAHWNSGATITCIPESFLEDEQPIKKTLIKTIHGEKQQNVYYVTFKVKGRKVEAEVIASPYEYILLSPTDVPWLTQQPLQLTILVPLQEYQEKILSKTALPEDQKQQLKTLFVKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPESYWLTAFTWQGKQYCWTRLPQGFLNSPALFTADVVDLLKEIPNVQVYVDDIYLSHDDPKEHVQQLEKVFQILLQAGYVVSLKKSEIGQKTVEFLGFNITKEGRGLTDTFKTKLLNITPPKDLKQLQSILGLLNFARNFIPNFAELVQPLYNLIASAKGKYIEWSEENTKQLNMVIEALNTASNLEERLPEQRLVIKVNTSPSAGYVRYYNETGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSQSPVKHPSQYEGVFYTDGSAIKSPDPTKSNNAGMGIVHATYKPEYQVLNQWSIPLGNHTAQMAEIAAVEFACKKALKIPGPVLVITDSFYVAESANKELPYWKSNGFVNNKKKPLKHISKWKSIAECLSMKPDITIQHEKGISLQIPVFILKGNALADKLATQGSYVVN

SEQ ID NO: 3158 - protein, 662 aa, synthetic construct
  source 1..662: note = Description of Artificial Sequence: Synthetic polypeptide
VPWLTQQPLQLTILVPLQEYQEKILSKTALPEDQKQQLKTLFVKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPESYWLTAFTWQGKQYCWTRLPQGFLNSPALFTADVVDLLKEIPNVQVYVDDIYLSHDDPKEHVQQLEKVFQILLQAGYVVSLKKSEIGQKTVEFLGFNITKEGRGLTDTFKTKLLNITPPKDLKQLQSILGLLNFARNFIPNFAELVQPLYNLIASAKGKYIEWSEENTKQLNMVIEALNTASNLEERLPEQRLVIKVNTSPSAGYVRYYNETGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSQSPVKHPSQYEGVFYTDGSAIKSPDPTKSNNAGMGIVHATYKPEYQVLNQWSIPLGNHTAQMAEIAAVEFACKKALKIPGPVLVITDSFYVAESANKELPYWKSNGFVNNKKKPLKHISKWKSIAECLSMKPDITIQHEKGISLQIPVFILKGNALADKLATQGSYVVN

SEQ ID NO: 3159 - protein, 662 aa, synthetic construct
  source 1..662: note = Description of Artificial Sequence: Synthetic polypeptide
VPWLTQQPLQLTILVPLQEYQEKILSKTALPEDQKQQLKTLFVKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPESYWLTAFTWQGKQYCWTRLPQGFLNSPALFNADVVDLLKEIPNVQVYVDDIYLSHDDPKEHVQQLEKVFQILLQAGYVVSLKKSEIGQKTVEFLGFNITKEGRGLTDTFKTKLLNITPPKDLKQLQSILGLLNFARNFIPNFAELVQPLYNLIAPAKGKYIEWSEENTKQLNMVIEALNTASNLEERLPEQRLVIKVNTSPSAGYVRYYNETGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSQSPVKHPSQYEGVFYTDGSAIKSPDPTKSNNAGMGIVHATYKPEYQVLNQWSIPLGNHTAQMAEIAAVEFACKKALKIPGPVLVITDSFYVAESANKELPYWKSNGFVNNKKKPLKHISKWKSIAECLSMKPDITIQHEKGISLQIPVFILKGNALADKLATQGSYVVN

SEQ ID NO: 3160 - protein, 662 aa, synthetic construct
  source 1..662: note = Description of Artificial Sequence: Synthetic polypeptide
VPWLTQQPLQLTILVPLQEYQEKILSKTALPEDQKQQLKTLFVKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPESYWLTAFTWQGKQYCWTRLPQGFLNSPALFNADVVDLLKEIPNVQVYVDDIYLSHDDPKEHVQQLEKVFQILLQAGYVVSLKKSEIGQKTVEFLGFNITKEGRGLTDTFKTKLLNITPPKDLKQLQSILGKLNFARNFIPNFAELVQPLYNLIAPAKGKYIEWSEENTKQLNMVIEALNTASNLEERLPEQRLVIKVNTSPSAGYVRYYNETGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSQSPVKHPSQYEGVFYTDGSAIKSPDPTKSNNAGMGIVHATYKPEYQVLNQWSIPLGNHTAQMAEIAAVEFACKKALKIPGPVLVITDSFYVAESANKELPYWKSNGFVNNKKKPLKHISKWKSIAECLSMKPDITIQHEKGISLQIPVFILKGNALADKLATQGSYVVN

SEQ ID NO: 3161 - protein, 751 aa, synthetic construct
  source 1..751: note = Description of Artificial Sequence: Synthetic polypeptide
MNPLQLLQPLPAEIKGTKLLAHWNSGATITCIPESFLEDEQPIKKTLIKTIHGEKQQNVYYVTFKVKGRKVEAEVIASPYEYILLSPTDVPWLTQQPLQLTILVPLQEYQEKILSKTALPEDQKQQLKTLFVKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPESYWLTAFTWQGKQYCWTRLPQGFLNSPALFNADVVDLLKEIPNVQVYVDDIYLSHDDPKEHVQQLEKVFQILLQAGYVVSLKKSEIGQKTVEFLGFNITKEGRGLTDTFKTKLLNITPPKDLKQLQSILGLLNFARNFIPNFAELVQPLYNLIAPAKGKYIEWSEENTKQLNMVIEALNTASNLEERLPEQRLVIKVNTSPSAGYVRYYNETGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSQSPVKHPSQYEGVFYTDGSAIKSPDPTKSNNAGMGIVHATYKPEYQVLNQWSIPLGNHTAQMAEIAAVEFACKKALKIPGPVLVITDSFYVAESANKELPYWKSNGFVNNKKKPLKHISKWKSIAECLSMKPDITIQHEKGISLQIPVFILKGNALADKLATQGSYVVN

SEQ ID NO: 3162 - protein, 751 aa, synthetic construct
  source 1..751: note = Description of Artificial Sequence: Synthetic polypeptide
MNPLQLLQPLPAEIKGTKLLAHWNSGATITCIPESFLEDEQPIKKTLIKTIHGEKQQNVYYVTFKVKGRKVEAEVIASPYEYILLSPTDVPWLTQQPLQLTILVPLQEYQEKILSKTALPEDQKQQLKTLFVKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPESYWLTAFTWQGKQYCWTRLPQGFLNSPALFNADVVDLLKEIPNVQVYVDDIYLSHDDPKEHVQQLEKVFQILLQAGYVVSLKKSEIGQKTVEFLGFNITKEGRGLTDTFKTKLLNITPPKDLKQLQSILGKLNFARNFIPNFAELVQPLYNLIAPAKGKYIEWSEENTKQLNMVIEALNTASNLEERLPEQRLVIKVNTSPSAGYVRYYNETGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSQSPVKHPSQYEGVFYTDGSAIKSPDPTKSNNAGMGIVHATYKPEYQVLNQWSIPLGNHTAQMAEIAAVEFACKKALKIPGPVLVITDSFYVAESANKELPYWKSNGFVNNKKKPLKHISKWKSIAECLSMKPDITIQHEKGISLQIPVFILKGNALADKLATQGSYVVN

SEQ ID NO: 3163 - protein, 669 aa, synthetic construct
  source 1..669: note = Description of Artificial Sequence: Synthetic polypeptide
VLNLEEEYRLHEKPVPSSIDPSWLQLFPTVWAERAGMGLANQVPPVVVELRSGASPVAVRQYPMSKEAREGIRPHIQKFLDLGVLVPCRSPWNTPLLPVKKPGTNDYRPVQDLREINKRVQDIHPTVPNPYNLLSSLPPSYTWYSVLDLKDAFFCLRLHPNSQPLFAFEWKDPEKGNTGQLTWTRLPQGFKNSPTLFDEALHRDLAPFRALNPQVVLLQYVDDLLVAAPTYEDCKKGTQKLLQELSKLGYRVSAKKAQLCQREVTYLGYLLKEGKRWLTPARKATVMKIPVPTTPRQVREFLGTAGFCRLWIPGFASLAAPLYPLTKESIPFIWTEEHQQAFDHIKKALLSAPALALPDLTKPFTLYIDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLEDQPLPGVPTWYTDGSSFITEGKRRAGAPIVDGKRTVWASSLPEGTSAQKAELVALTQALRLAEGKNINIYTDSRYAFATAHIHGAIYKQRGLLTSAGKDIKNKEEILALLEAIHLPRRVAIIHCPGHQRGSNPVATGNRRADEAAKQAALSTRVLAGTTKP

SEQ ID NO: 3164 - protein, 669 aa, synthetic construct
  source 1..669: note = Description of Artificial Sequence: Synthetic polypeptide
VLNLEEEYRLHEKPVPSSIDPSWLQLFPTVWAERAGMGLANQVPPVVVELRSGASPVAVRQYPMSKEAREGIRPHIQKFLDLGVLVPCRSPWNTPLLPVKKPGTNDYRPVQDLREINKRVQDIHPTVPNPYNLLSSLPPSYTWYSVLDLKDAFFCLRLHPNSQPLFAFEWKDPEKGNTGQLTWTRLPQGFKNSPTLFNEALHRDLAPFRALNPQVVLLQYVDDLLVAAPTYEDCKKGTQKLLQELSKLGYRVSAKKAQLCQREVTYLGYLLKEGKRWLTPARKATVMKIPVPTTPRQVREFLGTAGFCRLWIPGFASLAAPLYPLTKPSIPFIWTEEHQQAFDHIKKALLSAPALALPDLTKPFTLYIDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLEDQPLPGVPTWYTDGSSFITEGKRRAGAPIVDGKRTVWASSLPEGTSAQKAELVALTQALRLAEGKNINIYTDSRYAFATAHIHGAIYKQRGWLTSAGKDIKNKEEILALLEAIHLPRRVAIIHCPGHQRGSNPVATGNRRADEAAKQAALSTRVLAGTTKP

SEQ ID NO: 3165 - protein, 669 aa, synthetic construct
  source 1..669: note = Description of Artificial Sequence: Synthetic polypeptide
VLNLEEEYRLHEKPVPSSIDPSWLQLFPTVWAERAGMGLANQVPPVVVELRSGASPVAVRQYPMSKEAREGIRPHIQKFLDLGVLVPCRSPWNTPLLPVKKPGTNDYRPVQDLREINKRVQDIHPTVPNPYNLLSSLPPSYTWYSVLDLKDAFFCLRLHPNSQPLFAFEWKDPEKGNTGQLTWTRLPQGFKNSPTLFNEALHRDLAPFRALNPQVVLLQYVDDLLVAAPTYEDCKKGTQKLLQELSKLGYRVSAKKAQLCQREVTYLGYLLKEGKRWLTPARKATVMKIPVPTTPRQVREFLGKAGFCRLFIPGFASLAAPLYPLTKPSIPFIWTEEHQQAFDHIKKALLSAPALALPDLTKPFTLYIDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLEDQPLPGVPTWYTDGSSFITEGKRRAGAPIVDGKRTVWASSLPEGTSAQKAELVALTQALRLAEGKNINIYTDSRYAFATAHIHGAIYKQRGWLTSAGKDIKNKEEILALLEAIHLPRRVAIIHCPGHQRGSNPVATGNRRADEAAKQAALSTRVLAGTTKP

SEQ ID NO: 3166 - protein, 588 aa, synthetic construct
  source 1..588: note = Description of Artificial Sequence: Synthetic polypeptide
AVLGLEHLPRPPQISQFPLNPERLQALQHLVRKALEAGHIEPYTGPGNNPVFPVKKANGTWRFIHDLRATNSLTIDLSSSSPGPPDLSSLPTTLAHLQTIDLRDAFFQIPLPKQFQPYFAFTVPQQCNYGPGTRYAWKVLPQGFKNSPTLFEMQLAHILQPIRQAFPQCTILQYMDDILLASPSHEDLLLLSEATMASLISHGLPVSENKTQQTPGTIKFLGQIISPNHLTYDAVPTVPIRSRWALPELQALLGEIQWVSKGTPTLRQPLHSLYCALQRHTDPRDQIYLNPSQVQSLVQLRQALSQNCRSRLVQTLPLLGAIMLTLTGTTTVVFQSKEQWPLVWLHAPLPHTSQCPWGQLLASAVLLLDKYTLQSYGLLCQTIHHNISTQTFNQFIQTSDHPSVPILLHHSHRFKNLGAQTGELWNTFLKTAAPLAPVKALMPVFTLSPVIINTAPCLFSDGSTSRAAYILWDKQILSQRSFPLPPPHKSAQRAELLGLLHGLSSARSWRCLNIFLDSKYLYHYLRTLALGTFQGRSSQAPFQALLPRLLSRKVVYLHHVRSHTNLPDPISRLNALTDALLITPVLQL

SEQ ID NO: 3167 - protein, 588 aa, synthetic construct
  source 1..588: note = Description of Artificial Sequence: Synthetic polypeptide
AVLGLEHLPRPPQISQFPLNPERLQALQHLVRKALEAGHIEPYTGPGNNPVFPVKKANGTWRFIHDLRATNSLTIDLSSSSPGPPDLSSLPTTLAHLQTIDLRDAFFQIPLPKQFQPYFAFTVPQQCNYGPGTRYAWKVLPQGFKNSPTLFQMQLAHILQPIRQAFPQCTILQYMDDILLASPSHEDLLLLSEATMASLISHGLPVSENKTQQTPGTIKFLGQIISPNHLTYDAVPTVPIRSRWALPELQALLGEIQWVSKGTPTLRQPLHSLYCALQPHTDPRDQIYLNPSQVQSLVQLRQALSQNCRSRLVQTLPLLGAIMLTLTGTTTVVFQSKEQWPLVWLHAPLPHTSQCPWGQLLASAVLLLDKYTLQSYGLLCQTIHHNISTQTFNQFIQTSDHPSVPILLHHSHRFKNLGAQTGELWNTFLKTAAPLAPVKALMPVFTLSPVIINTAPCLFSDGSTSRAAYILWDKQILSQRSFPLPPPHKSAQRAELLGLLHGLSSARSWRCLNIFLDSKYLYHYLRTLALGTFQGRSSQAPFQALLPRLLSRKVVYLHHVRSHTNLPDPISRLNALTDALLITPVLQL

SEQ ID NO: 3168 - protein, 588 aa, synthetic construct
  source 1..588: note = Description of Artificial Sequence: Synthetic polypeptide
AVLGLEHLPRPPQISQFPLNPERLQALQHLVRKALEAGHIEPYTGPGNNPVFPVKKANGTWRFIHDLRATNSLTIDLSSSSPGPPDLSSPPTTLAHLQTIDLRDAFFQIPLPKQFQPYFAFTVPQQCNYGPGTRYAWKVLPQGFKNSPTLFQMQLAHILQPIRQAFPQCTILQYMDDILLASPSHEDLLLLSEATMASLISHGLPVSENKTQQTPGTIKFLGQIISPNHLTYDAVPTVPIRSRWALPELQALLGEIQWVSKGTPTLRQPLHSLYCALQPHTDPRDQIYLNPSQVQSLVQLRQALSQNCRSRLVQTLPLLGAIMLTLTGTTTVVFQSKEQWPLVWLHAPLPHTSQCPWGQLLASAVLLLDKYTLQSYGLLCQTIHHNISTQTFNQFIQTSDHPSVPILLHHSHRFKNLGAQTGELWNTFLKTAAPLAPVKALMPVFTLSPVIINTAPCLFSDGSTSRAAYILWDKQILSQRSFPLPPPHKSAQRAELLGLLHGLSSARSWRCLNIFLDSKYLYHYLRTLALGTFQGRSSQAPFQALLPRLLSRKVVYLHHVRSHTNLPDPISRLNALTDALLITPVLQL

SEQ ID NO: 3169 - protein, 588 aa, synthetic construct
  source 1..588: note = Description of Artificial Sequence: Synthetic polypeptide
AVLGLEHLPRPPEISQFPLNPERLQALQHLVRKALEAGHIEPYTGPGNNPVFPVKKANGTWRFIHDLRATNSLTIDLSSSSPGPPDLSSLPTTLAHLQTIDLKDAFFQIPLPKQFQPYFAFTVPQQCNYGPGTRYAWRVLPQGFKNSPTLFEMQLAHILQPIRQAFPQCTILQYMDDILLASPSHADLQLLSEATMASLISHGLPVSENKTQQTPGTIKFLGQIISPNHLTYDAVPKVPIRSRWALPELQALLGEIQWVSKGTPTLRQPLHSLYCALQRHTDPRDQIYLNPSQVQSLVQLRQALSQNCRSRLVQTLPLLGAIMLTLTGTTTVVFQSKQQWPLVWLHAPLPHTSQCPWGQLLASAVLLLDKYTLQSYGLLCQTIHHNISTQTFNQFIQTSDHPSVPILLHHSHRFKNLGAQTGELWNTFLKTTAPLAPVKALMPVFTLSPVIINTAPCLFSDGSTSQAAYILWDKHILSQRSFPLPPPHKSAQRAELLGLLHGLSSARSWRCLNIFLDSKYLYHYLRTLALGTFQGRSSQAPFQALLPRLLSRKVVYLHHVRSHTNLPDPISRLNALTDALLITPVLQL

SEQ ID NO: 3170 - protein, 588 aa, synthetic construct
  source 1..588: note = Description of Artificial Sequence: Synthetic polypeptide
AVLGLEHLPRPPEISQFPLNPERLQALQHLVRKALEAGHIEPYTGPGNNPVFPVKKANGTWRFIHDLRATNSLTIDLSSSSPGPPDLSSLPTTLAHLQTIDLKDAFFQIPLPKQFQPYFAFTVPQQCNYGPGTRYAWRVLPQGFKNSPTLFQMQLAHILQPIRQAFPQCTILQYMDDILLASPSHADLQLLSEATMASLISHGLPVSENKTQQTPGTIKFLGQIISPNHLTYDAVPKVPIRSRWALPELQALLGEIQWVSKGTPTLRQPLHSLYCALQPHTDPRDQIYLNPSQVQSLVQLRQALSQNCRSRLVQTLPLLGAIMLTLTGTTTVVFQSKQQWPLVWLHAPLPHTSQCPWGQLLASAVLLLDKYTLQSYGLLCQTIHHNISTQTFNQFIQTSDHPSVPILLHHSHRFKNLGAQTGELWNTFLKTTAPLAPVKALMPVFTLSPVIINTAPCLFSDGSTSQAAYILWDKHILSQRSFPLPPPHKSAQRAELLGLLHGLSSARSWRCLNIFLDSKYLYHYLRTLALGTFQGRSSQAPFQALLPRLLSRKVVYLHHVRSHTNLPDPISRLNALTDALLITPVLQL

SEQ ID NO: 3171 - protein, 588 aa, synthetic construct
  source 1..588: note = Description of Artificial Sequence: Synthetic polypeptide
AVLGLEHLPRPPEISQFPLNPERLQALQHLVRKALEAGHIEPYTGPGNNPVFPVKKANGTWRFIHDLRATNSLTIDLSSSSPGPPDLSSPPTTLAHLQTIDLKDAFFQIPLPKQFQPYFAFTVPQQCNYGPGTRYAWRVLPQGFKNSPTLFQMQLAHILQPIRQAFPQCTILQYMDDILLASPSHADLQLLSEATMASLISHGLPVSENKTQQTPGTIKFLGQIISPNHLTYDAVPKVPIRSRWALPELQALLGEIQWVSKGTPTLRQPLHSLYCALQPHTDPRDQIYLNPSQVQSLVQLRQALSQNCRSRLVQTLPLLGAIMLTLTGTTTVVFQSKQQWPLVWLHAPLPHTSQCPWGQLLASAVLLLDKYTLQSYGLLCQTIHHNISTQTFNQFIQTSDHPSVPILLHHSHRFKNLGAQTGELWNTFLKTTAPLAPVKALMPVFTLSPVIINTAPCLFSDGSTSQAAYILWDKHILSQRSFPLPPPHKSAQRAELLGLLHGLSSARSWRCLNIFLDSKYLYHYLRTLALGTFQGRSSQAPFQALLPRLLSRKVVYLHHVRSHTNLPDPISRLNALTDALLITPVLQL

SEQ ID NO: 3172 - protein, 583 aa, synthetic construct
  source 1..583: note = Description of Artificial Sequence: Synthetic polypeptide
GLEHLPRPPEISQFPLNPERLQALQHLVRKALEAGHIEPYTGPGNNPVFPVKKANGTWRFIHDLRATNSLTVDLSSSSPGPPDLSSLPTTLAHLQTIDLKDAFFQIPLPKQFQPYFAFTVPQQCNYGPGTRYAWKVLPQGFKNSPTLFEMQLASILQPIRQAFPQCVILQYMDDILLASPSPEDLQQLSEATMASLISHGLPVSQDKTQQTPGTIKFLGQIISPNHITYDAVPTVPIRSRWALPELQALLGEIQWVSKGTPTLRQPLHSLYCALQGHTDPRDQIYLNPSQVQSLMQLQQALSQNCRSRLAQTLPLLGAIMLTLTGTTTVVFQSKQQWPLVWLHAPLPHTSQCPWGQLLASAVLLLDKYTLQSYGLLCQTIHHNISIQTFNQFIQTSDHPSVPILLHHSHRFKNLGAQTGELWNTFLKTAAPLAPVKALTPVFTLSPIIINTAPCLFSDGSTSQAAYILWDKHILSQRSFPLPPPHKSAQQAELLGLLHGLSSARSWHCLNIFLDSKYLYHYLRTLALGTFQGKSSQAPFQALLPRLLAHKVIYLHHVRSHTNLPDPISKLNALTDALLITPIL

SEQ ID NO: 3173 - protein, 583 aa, synthetic construct
  source 1..583: note = Description of Artificial Sequence: Synthetic polypeptide
GLEHLPRPPEISQFPLNPERLQALQHLVRKALEAGHIEPYTGPGNNPVFPVKKANGTWRFIHDLRATNSLTVDLSSSSPGPPDLSSLPTTLAHLQTIDLKDAFFQIPLPKQFQPYFAFTVPQQCNYGPGTRYAWKVLPQGFKNSPTLFQMQLASILQPIRQAFPQCVILQYMDDILLASPSPEDLQQLSEATMASLISHGLPVSQDKTQQTPGTIKFLGQIISPNHITYDAVPTVPIRSRWALPELQALLGEIQWVSKGTPTLRQPLHSLYCALQGHTDPRDQIYLNPSQVQSLMQLQQALSQNCRSRLAQTLPLLGAIMLTLTGTTTVVFQSKQQWPLVWLHAPLPHTSQCPWGQLLASAVLLLDKYTLQSYGLLCQTIHHNISIQTFNQFIQTSDHPSVPILLHHSHRFKNLGAQTGELWNTFLKTAAPLAPVKALTPVFTLSPIIINTAPCLFSDGSTSQAAYILWDKHILSQRSFPLPPPHKSAQQAELLGLLHGLSSARSWHCLNIFLDSKYLYHYLRTLAWGTFQGKSSQAPFQALLPRLLAHKVIYLHHVRSHTNLPDPISKLNALTDALLITPIL

SEQ ID NO: 3174 - protein, 583 aa, synthetic construct
  source 1..583: note = Description of Artificial Sequence: Synthetic polypeptide
GLEHLPRPPEISQFPLNPERLQALQHLVRKALEAGHIEPYTGPGNNPVFPVKKANGTWRFIHDLRATNSLTVDLSSSSPGPPDLSSPPTTLAHLQTIDLKDAFFQIPLPKQFQPYFAFTVPQQCNYGPGTRYAWKVLPQGFKNSPTLFQMQLASILQPIRQAFPQCVILQYMDDILLASPSPEDLQQLSEATMASLISHGLPVSQDKTQQTPGTIKFLGQIISPNHITYDAVPTVPIRSRWALPELQALLGEIQWVSKGTPTLRQPLHSLYCALQGHTDPRDQIYLNPSQVQSLMQLQQALSQNCRSRLAQTLPLLGAIMLTLTGTTTVVFQSKQQWPLVWLHAPLPHTSQCPWGQLLASAVLLLDKYTLQSYGLLCQTIHHNISIQTFNQFIQTSDHPSVPILLHHSHRFKNLGAQTGELWNTFLKTAAPLAPVKALTPVFTLSPIIINTAPCLFSDGSTSQAAYILWDKHILSQRSFPLPPPHKSAQQAELLGLLHGLSSARSWHCLNIFLDSKYLYHYLRTLAWGTFQGKSSQAPFQALLPRLLAHKVIYLHHVRSHTNLPDPISKLNALTDALLITPIL

SEQ ID NO: 3175 - protein, 584 aa, synthetic construct
  source 1..584: note = Description of Artificial Sequence: Synthetic polypeptide
GLEHLPPPPEVSQFPLNPERLQALTDLVSRALEAKHIEPYQGPGNNPIFPVKKPNGKWRFIHDLRATNSVTRDLASPSPGPPDLTSLPQGLPHLRTIDLTDAFFQIPLPTIFQPYFAFTLPQPNNYGPGTRYSWRVLPQGFKNSPTLFEQQLSHILTPVRKTFPNSLIIQYMDDILLASPAPGELAALTDKVTNALTKEGLPLSPEKTQATPGPIHFLGQVISQDCITYETLPSINVKSTWSLAELQSMLGELQWVSKGTPVLRSSLHQLYLALRGHRDPRDTIKLTSIQVQALRTIQKALTLNCRSRLVNQLPILALIMLRPTGTTAVLFQTKQKWPLVWLHTPHPATSLRPWGQLLANAVIILDKYSLQHYGQVCKSFHHNISNQALTYYLHTSDQSSVAILLQHSHRFHNLGAQPSGPWRSLLQMPQIFQNIDVLRPPFTISPVVINHAPCLFSDGSASKAAFIIWDRQVIHQQVLSLPSTCSAQAGELFGLLAGLQKSQPWVALNIFLDSKFLIGHLRRMALGAFPGPSTQCELHTQLLPLLQGKTVYVHHVRSHTLLQDPISRLNEATDALMLAPLLPL

SEQ ID NO: 3176 - protein, 584 aa, synthetic construct
  source 1..584: note = Description of Artificial Sequence: Synthetic polypeptide
GLEHLPPPPEVSQFPLNPERLQALTDLVSRALEAKHIEPYQGPGNNPIFPVKKPNGKWRFIHDLRATNSVTRDLASPSPGPPDLTSLPQGLPHLRTIDLTDAFFQIPLPTIFQPYFAFTLPQPNNYGPGTRYSWRVLPQGFKNSPTLFQQQLSHILTPVRKTFPNSLIIQYMDDILLASPAPGELAALTDKVTNALTKEGLPLSPEKTQATPGPIHFLGQVISQDCITYETLPSINVKSTWSLAELQSMLGELQWVSKGTPVLRSSLHQLYLALRGHRDPRDTIKLTSIQVQALRTIQKALTLNCRSRLVNQLPILALIMLRPTGTTAVLFQTKQKWPLVWLHTPHPATSLRPWGQLLANAVIILDKYSLQHYGQVCKSFHHNISNQALTYYLHTSDQSSVAILLQHSHRFHNLGAQPSGPWRSLLQMPQIFQNIDVLRPPFTISPVVINHAPCLFSDGSASKAAFIIWDRQVIHQQVLSLPSTCSAQAGELFGLLAGLQKSQPWVALNIFLDSKFLIGHLRRMAWGAFPGPSTQCELHTQLLPLLQGKTVYVHHVRSHTLLQDPISRLNEATDALMLAPLLPL

SEQ ID NO: 3177 - protein, 584 aa, synthetic construct
  source 1..584: note = Description of Artificial Sequence: Synthetic polypeptide
GLEHLPPPPEVSQFPLNPERLQALTDLVSRALEAKHIEPYQGPGNNPIFPVKKPNGKWRFIHDLRATNSVTRDLASPSPGPPDLTSPPQGLPHLRTIDLTDAFFQIPLPTIFQPYFAFTLPQPNNYGPGTRYSWRVLPQGFKNSPTLFQQQLSHILTPVRKTFPNSLIIQYMDDILLASPAPGELAALTDKVTNALTKEGLPLSPEKTQATPGPIHFLGQVISQDCITYETLPSINVKSTWSLAELQSMLGELQWVSKGTPVLRSSLHQLYLALRGHRDPRDTIKLTSIQVQALRTIQKALTLNCRSRLVNQLPILALIMLRPTGTTAVLFQTKQKWPLVWLHTPHPATSLRPWGQLLANAVIILDKYSLQHYGQVCKSFHHNISNQALTYYLHTSDQSSVAILLQHSHRFHNLGAQPSGPWRSLLQMPQIFQNIDVLRPPFTISPVVINHAPCLFSDGSASKAAFIIWDRQVIHQQVLSLPSTCSAQAGELFGLLAGLQKSQPWVALNIFLDSKFLIGHLRRMAWGAFPGPSTQCELHTQLLPLLQGKTVYVHHVRSHTLLQDPISRLNEATDALMLAPLLPL

SEQ ID NO: 3178 - protein, 584 aa, synthetic construct
  source 1..584: note = Description of Artificial Sequence: Synthetic polypeptide
GLEHLPPPPEVSQFPLNPERLQALTDLVSRALEAKHIEPYQGPGNNPIFPVKKPNGKWRFIHDLRATNSLTRDLASPSPGPPDLTSLPQDLPHLRTIDLTDAFFQIPLPAVFQPYFAFTLPQPNNHGPGTRYSWRVLPQGFKNSPTLFEQQLSHILAPVRKAFPNSLIIQYMDDILLASPALRELTALTDKVTNALTKEGLPMSLEKTQATPGSIHFLGQVISPDCITYETLPSIHVKSIWSLAELQSMLGELQWVSKGTPVLRSSLHQLYLALRGHRDPRDTIELTSTQVQALKTIQKALALNCRSRLVSQLPILALIILRPTGTTAVLFQTKQKWPLVWLHTPHPATSLRPWGQLLANAIITLDKYSLQHYGQICKSFHHNISNQALTYYLHTSDQSSVAILLQHSHRFHNLGAQPSGPWRSLLQVPQIFQNIDVLRPPFIISPVVIDHAPCLFSDGATSKAAFILWDKQVIHQQVLPLPSTCSAQAGELFGLLAGLQKSKPWPALNIFLDSKFLIGHLRRMALGAFLGPSTQCDLHARLFPLLQGKTVYVHHVRSHTLLQDPISRLNEATDALMLAPLLPL

SEQ ID NO: 3179 - protein, 584 aa, synthetic construct
  source 1..584: note = Description of Artificial Sequence: Synthetic polypeptide
GLEHLPPPPEVSQFPLNPERLQALTDLVSRALEAKHIEPYQGPGNNPIFPVKKPNGKWRFIHDLRATNSLTRDLASPSPGPPDLTSLPQDLPHLRTIDLTDAFFQIPLPAVFQPYFAFTLPQPNNHGPGTRYSWRVLPQGFKNSPTLFQQQLSHILAPVRKAFPNSLIIQYMDDILLASPALRELTALTDKVTNALTKEGLPMSLEKTQATPGSIHFLGQVISPDCITYETLPSIHVKSIWSLAELQSMLGELQWVSKGTPVLRSSLHQLYLALRGHRDPRDTIELTSTQVQALKTIQKALALNCRSRLVSQLPILALIILRPTGTTAVLFQTKQKWPLVWLHTPHPATSLRPWGQLLANAIITLDKYSLQHYGQICKSFHHNISNQALTYYLHTSDQSSVAILLQHSHRFHNLGAQPSGPWRSLLQVPQIFQNIDVLRPPFIISPVVIDHAPCLFSDGATSKAAFILWDKQVIHQQVLPLPSTCSAQAGELFGLLAGLQKSKPWPALNIFLDSKFLIGHLRRMAWGAFLGPSTQCDLHARLFPLLQGKTVYVHHVRSHTLLQDPISRLNEATDALMLAPLLPL

SEQ ID NO: 3180 - protein, 584 aa, synthetic construct
  source 1..584: note = Description of Artificial Sequence: Synthetic polypeptide
GLEHLPPPPEVSQFPLNPERLQALTDLVSRALEAKHIEPYQGPGNNPIFPVKKPNGKWRFIHDLRATNSLTRDLASPSPGPPDLTSPPQDLPHLRTIDLTDAFFQIPLPAVFQPYFAFTLPQPNNHGPGTRYSWRVLPQGFKNSPTLFQQQLSHILAPVRKAFPNSLIIQYMDDILLASPALRELTALTDKVTNALTKEGLPMSLEKTQATPGSIHFLGQVISPDCITYETLPSIHVKSIWSLAELQSMLGELQWVSKGTPVLRSSLHQLYLALRGHRDPRDTIELTSTQVQALKTIQKALALNCRSRLVSQLPILALIILRPTGTTAVLFQTKQKWPLVWLHTPHPATSLRPWGQLLANAIITLDKYSLQHYGQICKSFHHNISNQALTYYLHTSDQSSVAILLQHSHRFHNLGAQPSGPWRSLLQVPQIFQNIDVLRPPFIISPVVIDHAPCLFSDGATSKAAFILWDKQVIHQQVLPLPSTCSAQAGELFGLLAGLQKSKPWPALNIFLDSKFLIGHLRRMAWGAFLGPSTQCDLHARLFPLLQGKTVYVHHVRSHTLLQDPISRLNEATDALMLAPLLPL

SEQ ID NO: 3181 - protein, 584 aa, synthetic construct
  source 1..584: note = Description of Artificial Sequence: Synthetic polypeptide
HLPPPPQVDQFPLNLPERLQALNDLVSKALEAGHIEPYSGPGNNPVFPVKKPNGKWRFIHDLRATNAITTTLTSPSPGPPDLTSLPTALPHLQTIDLTDAFFQIPLPKQYQPYFAFTIPQPCNYGPGTRYAWTVLPQGFKNSPTLFEQQLAAVLNPMRKMFPTSTIVQYMDDILLASPTNEELQQLSQLTLQALTTHGLPISQEKTQQTPGQIRFLGQVISPNHITYESTPTIPIKSQWTLTELQVILGEIQWVSKGTPILRKHLQSLYSALHGYRDPRACITLTPQQLHALHAIQQALQHNCRGRLNPALPLLGLISLSTSGTTSVIFQPKQNWPLAWLHTPHPPTSLCPWGHLLACTILTLDKYTLQHYGQLCQSFHHNMSKQALCDFLRNSPHPSVGILIHHMGRFHNLGSQPSGPWKTLLHLPTLLQEPRLLRPIFTLSPVVLDTAPCLFSDGSPQKAAYVLWDQTILQQDITPLPSHETHSAQKGELLALICGLRAAKPWPSLNIFLDSKYLIKYLHSLAIGAFLGTSAHQTLQAALPPLLQGKTIYLHHVRSHTNLPDPISTFNEYTDSLILAPLVPL

SEQ ID NO: 3182 - protein, 584 aa, synthetic construct
  source 1..584: note = Description of Artificial Sequence: Synthetic polypeptide
HLPPPPQVDQFPLNLPERLQALNDLVSKALEAGHIEPYSGPGNNPVFPVKKPNGKWRFIHDLRATNAITTTLTSPSPGPPDLTSLPTALPHLQTIDLTDAFFQIPLPKQYQPYFAFTIPQPCNYGPGTRYAWTVLPQGFKNSPTLFQQQLAAVLNPMRKMFPTSTIVQYMDDILLASPTNEELQQLSQLTLQALTTHGLPISQEKTQQTPGQIRFLGQVISPNHITYESTPTIPIKSQWTLTELQVILGEIQWVSKGTPILRKHLQSLYSALHPYRDPRACITLTPQQLHALHAIQQALQHNCRGRLNPALPLLGLISLSTSGTTSVIFQPKQNWPLAWLHTPHPPTSLCPWGHLLACTILTLDKYTLQHYGQLCQSFHHNMSKQALCDFLRNSPHPSVGILIHHMGRFHNLGSQPSGPWKTLLHLPTLLQEPRLLRPIFTLSPVVLDTAPCLFSDGSPQKAAYVLWDQTILQQDITPLPSHETHSAQKGELLALICGLRAAKPWPSLNIFLDSKYLIKYLHSLAIGAFLGTSAHQTLQAALPPLLQGKTIYLHHVRSHTNLPDPISTFNEYTDSLILAPLVPL

SEQ ID NO: 3183 - protein, 584 aa, synthetic construct
  source 1..584: note = Description of Artificial Sequence: Synthetic polypeptide
HLPPPPQVDQFPLNLPERLQALNDLVSKALEAGHIEPYSGPGNNPVFPVKKPNGKWRFIHDLRATNAITTTLTSPSPGPPDLTSPPTALPHLQTIDLTDAFFQIPLPKQYQPYFAFTIPQPCNYGPGTRYAWTVLPQGFKNSPTLFQQQLAAVLNPMRKMFPTSTIVQYMDDILLASPTNEELQQLSQLTLQALTTHGLPISQEKTQQTPGQIRFLGQVISPNHITYESTPTIPIKSQWTLTELQVILGEIQWVSKGTPILRKHLQSLYSALHPYRDPRACITLTPQQLHALHAIQQALQHNCRGRLNPALPLLGLISLSTSGTTSVIFQPKQNWPLAWLHTPHPPTSLCPWGHLLACTILTLDKYTLQHYGQLCQSFHHNMSKQALCDFLRNSPHPSVGILIHHMGRFHNLGSQPSGPWKTLLHLPTLLQEPRLLRPIFTLSPVVLDTAPCLFSDGSPQKAAYVLWDQTILQQDITPLPSHETHSAQKGELLALICGLRAAKPWPSLNIFLDSKYLIKYLHSLAIGAFLGTSAHQTLQAALPPLLQGKTIYLHHVRSHTNLPDPISTFNEYTDSLILAPLVPL

SEQ ID NO: 3184 - protein, 581 aa, synthetic construct
  source 1..581: note = Description of Artificial Sequence: Synthetic polypeptide
PLGTSDSPVTHADPIDWKSEEPVWVDQWPLTQEKLSAAQQLVQEQLRLGHIEPSTSAWNSPIFVIKKKSGKWRLLQDLRKVNETMMHMGALQPGLPTPSAIPDKSYIIVIDLKDCFYTIPLAPQDCKRFAFSLPSVNFKEPMQRYQWRVLPQGMTNSPTLCQKFVATAIAPVRQRFPQLYLVHYMDDILLAHTDEHLLYQAFSILKQHLSLNGLVIADEKIQTHFPYNYLGFSLYPRVYNTQLVKLQTDHLKTLNDFQKLLGDINWIRPYLKLPTYTLQPLFDILKGDSDPASPRTLSLEGRTALQSIEEAIRQQQITYCDYQRSWGLYILPTPRAPTGVLYQDKPLRWIYLSATPTKHLLPYYELVAKIIAKGRHEAIQYFGMEPPFICVPYALEQQDWLFQFSDNWSIAFANYPGQITHHYPSDKLLQFASSHAFIFPKIVRRQPIPEATLIFTDGSSNGTAALIINHQTYYAQTSFSSAQVVELFAVHQALLTVPTSFNLFTDSSYVVGALQMIETVPIIGTTSPEVLNLFTLIQQVLHCRQHPCFFGHIRAHSTLPGALVQGNHTADVLTKQVFFQS

SEQ ID NO: 3185 - protein, 581 aa, synthetic construct
  source 1..581: note = Description of Artificial Sequence: Synthetic polypeptide
PLGTSDSPVTHADPIDWKSEEPVWVDQWPLTQEKLSAAQQLVQEQLRLGHIEPSTSAWNSPIFVIKKKSGKWRLLQDLRKVNETMMHMGALQPGLPTPSPIPDKSYIIVIDLKDCFYTIPLAPQDCKRFAFSLPSVNFKEPMQRYQWRVLPQGMTNSPTLCQKFVATAIAPVRQRFPQLYLVHYMDDILLAHTDEHLLYQAFSILKQHLSLNGLVIADEKIQTHFPYNYLGFSLYPRVYNTQLVKLQTDHLKTLNDFQKLLGDINWIRPYLKLPTYTLQPLFDILKGDSDPASPRTLSLEGRTALQSIEEAIRQQQITYCDYQRSWGLYILPTPRAPTGVLYQDKPLRWIYLSATPTKHLLPYYELVAKIIAKGRHEAIQYFGMEPPFICVPYALEQQDWLFQFSDNWSIAFANYPGQITHHYPSDKLLQFASSHAFIFPKIVRRQPIPEATLIFTDGSSNGTAALIINHQTYYAQTSFSSAQVVELFAVHQALLTVPTSFNLFTDSSYVVGALQMIETVPIIGTTSPEVLNLFTLIQQVLHCRQHPCFFGHIRAHSTLPGALVQGNHTADVLTKQVFFQS

SEQ ID NO: 3186 - protein, 793 aa, synthetic construct
  source 1..793: note = Description of Artificial Sequence: Synthetic polypeptide
TLGDQGSRGSDPLPEPRVTLTVEGIPTEFLVNTGAEHSVLTKPMGKMGSKRTVVAGATGSKVYPWTTKRLLKIGQKQVTHSFLVIPECPAPLLGRDLLTKLKAQIQFSTEGPQVTWEDRPAMCLVLNLEEEYRLHEKPVPPSIDPSWLQLFPMVWAEKAGMGLANQVPPVVVELKSDASPVAVRQYPMSKEAREGIRPHIQRFLDLGILVPCQSPWNTPLLPVKKPGTNDYRPVQDLREVNKRVQDIHPTVPNPYNLLSSLPPSHTWYSVLDLKDAFFCLKLHPNSQPLFAFEWRDPEKGNTGQLTWTRLPQGFKNSPTLFDEALHRDLASFRALNPQVVMLQYVDDLLVAAPTYRDCKEGTRRLLQELSKLGYRVSAKKAQLCREEVTYLGYLLKGGKRWLTPARKATVMKIPTPTTPRQVREFLGTAGFCRLWIPGFASLAAPLYPLTREKVPFTWTEAHQEAFGRIKEALLSAPALALPDLTKPFALYVDEKEGVARGVLTQTLGPWRRPVAYLSKKLDPVASGWPTCLKAIAAVALLLKDADKLTLGQNVLVIAPHNLESIVRQPPDRWMTNARMTHYQSLLLNERVSFAPPAILNPATLLPVESDDTPIHICSEILAEETGTRPDLRDQPLPGVPAWYTDGSSFIMDGRRQAGAAIVDNKRTVWASNLPEGTSAQKAELIALTQALRLAEGKSINIYTDSRYAFATAHVHGAIYKQRGLLTSAGKDIKNKEEILALLEAIHLPKRVAIIHCPGHQRGTDPVATGNRKADEAAKQAAQSTRILTETTKN

SEQ ID NO: 3187 - protein, 702 aa, synthetic construct
  source 1..702: note = Description of Artificial Sequence: Synthetic polypeptide
LLGRDLLTKLKAQIQFSTEGPQVTWEDRPAMCLVLNLEEEYRLHEKPVPPSIDPSWLQLFPMVWAEKAGMGLANQVPPVVVELKSDASPVAVRQYPMSKEAREGIRPHIQRFLDLGILVPCQSPWNTPLLPVKKPGTNDYRPVQDLREVNKRVQDIHPTVPNPYNLLSSLPPSHTWYSVLDLKDAFFCLKLHPNSQPLFAFEWRDPEKGNTGQLTWTRLPQGFKNSPTLFDEALHRDLASFRALNPQVVMLQYVDDLLVAAPTYRDCKEGTRRLLQELSKLGYRVSAKKAQLCREEVTYLGYLLKGGKRWLTPARKATVMKIPTPTTPRQVREFLGTAGFCRLWIPGFASLAAPLYPLTREKVPFTWTEAHQEAFGRIKEALLSAPALALPDLTKPFALYVDEKEGVARGVLTQTLGPWRRPVAYLSKKLDPVASGWPTCLKAIAAVALLLKDADKLTLGQNVLVIAPHNLESIVRQPPDRWMTNARMTHYQSLLLNERVSFAPPAILNPATLLPVESDDTPIHICSEILAEETGTRPDLRDQPLPGVPAWYTDGSSFIMDGRRQAGAAIVDNKRTVWASNLPEGTSAQKAELIALTQALRLAEGKSINIYTDSRYAFATAHVHGAIYKQRGLLTSAGKDIKNKEEILALLEAIHLPKRVAIIHCPGHQRGTDPVATGNRKADEAAKQAAQSTRILTETTKN

SEQ ID NO: 3188 - protein, 702 aa, synthetic construct
  source 1..702: note = Description of Artificial Sequence: Synthetic polypeptide
LLGRDLLTKLKAQIQFSTEGPQVTWEDRPAMCLVLNLEEEYRLHEKPVPPSIDPSWLQLFPMVWAEKAGMGLANQVPPVVVELKSDASPVAVRQYPMSKEAREGIRPHIQRFLDLGILVPCQSPWNTPLLPVKKPGTNDYRPVQDLREVNKRVQDIHPTVPNPYNLLSSLPPSHTWYSVLDLKDAFFCLKLHPNSQPLFAFEWRDPEKGNTGQLTWTRLPQGFKNSPTLFNEALHRDLASFRALNPQVVMLQYVDDLLVAAPTYRDCKEGTRRLLQELSKLGYRVSAKKAQLCREEVTYLGYLLKGGKRWLTPARKATVMKIPTPTTPRQVREFLGTAGFCRLWIPGFASLAAPLYPLTRPKVPFTWTEAHQEAFGRIKEALLSAPALALPDLTKPFALYVDEKEGVARGVLTQTLGPWRRPVAYLSKKLDPVASGWPTCLKAIAAVALLLKDADKLTLGQNVLVIAPHNLESIVRQPPDRWMTNARMTHYQSLLLNERVSFAPPAILNPATLLPVESDDTPIHICSEILAEETGTRPDLRDQPLPGVPAWYTDGSSFIMDGRRQAGAAIVDNKRTVWASNLPEGTSAQKAELIALTQALRLAEGKSINIYTDSRYAFATAHVHGAIYKQRGWLTSAGKDIKNKEEILALLEAIHLPKRVAIIHCPGHQRGTDPVATGNRKADEAAKQAAQSTRILTETTKN

SEQ ID NO: 3189 - protein, 702 aa, synthetic construct
  source 1..702: note = Description of Artificial Sequence: Synthetic polypeptide
LLGRDLLTKLKAQIQFSTEGPQVTWEDRPAMCLVLNLEEEYRLHEKPVPPSIDPSWLQLFPMVWAEKAGMGLANQVPPVVVELKSDASPVAVRQYPMSKEAREGIRPHIQRFLDLGILVPCQSPWNTPLLPVKKPGTNDYRPVQDLREVNKRVQDIHPTVPNPYNLLSSLPPSHTWYSVLDLKDAFFCLKLHPNSQPLFAFEWRDPEKGNTGQLTWTRLPQGFKNSPTLFNEALHRDLASFRALNPQVVMLQYVDDLLVAAPTYRDCKEGTRRLLQELSKLGYRVSAKKAQLCREEVTYLGYLLKGGKRWLTPARKATVMKIPTPTTPRQVREFLGKAGFCRLFIPGFASLAAPLYPLTRPKVPFTWTEAHQEAFGRIKEALLSAPALALPDLTKPFALYVDEKEGVARGVLTQTLGPWRRPVAYLSKKLDPVASGWPTCLKAIAAVALLLKDADKLTLGQNVLVIAPHNLESIVRQPPDRWMTNARMTHYQSLLLNERVSFAPPAILNPATLLPVESDDTPIHICSEILAEETGTRPDLRDQPLPGVPAWYTDGSSFIMDGRRQAGAAIVDNKRTVWASNLPEGTSAQKAELIALTQALRLAEGKSINIYTDSRYAFATAHVHGAIYKQRGWLTSAGKDIKNKEEILALLEAIHLPKRVAIIHCPGHQRGTDPVATGNRKADEAAKQAAQSTRILTETTKN

SEQ ID NO: 3190 - protein, 793 aa, synthetic construct
  source 1..793: note = Description of Artificial Sequence: Synthetic polypeptide
TLGDQGSRGSDPLPEPRVTLTVEGIPTEFLVNTGAEHSVLTKPMGKMGSKRTVVAGATGSKVYPWTTKRLLKIGQKQVTHSFLVIPECPAPLLGRDLLTKLKAQIQFSTEGPQVTWEDRPAMCLVLNLEEEYRLHEKPVPPSIDPSWLQLFPMVWAEKAGMGLANQVPPVVVELKSDASPVAVRQYPMSKEAREGIRPHIQRFLDLGILVPCQSPWNTPLLPVKKPGTNDYRPVQDLREVNKRVQDIHPTVPNPYNLLSSLPPSHTWYSVLDLKDAFFCLKLHPNSQPLFAFEWRDPEKGNTGQLTWTRLPQGFKNSPTLFNEALHRDLASFRALNPQVVMLQYVDDLLVAAPTYRDCKEGTRRLLQELSKLGYRVSAKKAQLCREEVTYLGYLLKGGKRWLTPARKATVMKIPTPTTPRQVREFLGTAGFCRLWIPGFASLAAPLYPLTRPKVPFTWTEAHQEAFGRIKEALLSAPALALPDLTKPFALYVDEKEGVARGVLTQTLGPWRRPVAYLSKKLDPVASGWPTCLKAIAAVALLLKDADKLTLGQNVLVIAPHNLESIVRQPPDRWMTNARMTHYQSLLLNERVSFAPPAILNPATLLPVESDDTPIHICSEILAEETGTRPDLRDQPLPGVPAWYTDGSSFIMDGRRQAGAAIVDNKRTVWASNLPEGTSAQKAELIALTQALRLAEGKSINIYTDSRYAFATAHVHGAIYKQRGWLTSAGKDIKNKEEILALLEAIHLPKRVAIIHCPGHQRGTDPVATGNRKADEAAKQAAQSTRILTETTKN

SEQ ID NO: 3191 - protein, 793 aa, synthetic construct
  source 1..793: note = Description of Artificial Sequence: Synthetic polypeptide
TLGDQGSRGSDPLPEPRVTLTVEGIPTEFLVNTGAEHSVLTKPMGKMGSKRTVVAGATGSKVYPWTTKRLLKIGQKQVTHSFLVIPECPAPLLGRDLLTKLKAQIQFSTEGPQVTWEDRPAMCLVLNLEEEYRLHEKPVPPSIDPSWLQLFPMVWAEKAGMGLANQVPPVVVELKSDASPVAVRQYPMSKEAREGIRPHIQRFLDLGILVPCQSPWNTPLLPVKKPGTNDYRPVQDLREVNKRVQDIHPTVPNPYNLLSSLPPSHTWYSVLDLKDAFFCLKLHPNSQPLFAFEWRDPEKGNTGQLTWTRLPQGFKNSPTLFNEALHRDLASFRALNPQVVMLQYVDDLLVAAPTYRDCKEGTRRLLQELSKLGYRVSAKKAQLCREEVTYLGYLLKGGKRWLTPARKATVMKIPTPTTPRQVREFLGKAGFCRLFIPGFASLAAPLYPLTRPKVPFTWTEAHQEAFGRIKEALLSAPALALPDLTKPFALYVDEKEGVARGVLTQTLGPWRRPVAYLSKKLDPVASGWPTCLKAIAAVALLLKDADKLTLGQNVLVIAPHNLESIVRQPPDRWMTNARMTHYQSLLLNERVSFAPPAILNPATLLPVESDDTPIHICSEILAEETGTRPDLRDQPLPGVPAWYTDGSSFIMDGRRQAGAAIVDNKRTVWASNLPEGTSAQKAELIALTQALRLAEGKSINIYTDSRYAFATAHVHGAIYKQRGWLTSAGKDIKNKEEILALLEAIHLPKRVAIIHCPGHQRGTDPVATGNRKADEAAKQAAQSTRILTETTKN

SEQ ID NO: 3192 - protein, 671 aa, synthetic construct
  source 1..671: note = Description of Artificial Sequence: Synthetic polypeptide
TLNLEDEYRLYETSAEPEVSPGSTWLSDFPQAWAETGGMGLAVRQAPLIIPLKATSTPVSIKQYPMSQEAKLGIKPHIQRLLDQGILVPCQSPWNTPLLPVKKPGTNDYRPVQDLREVNKRVEDIHPTVPNPYNLLSGLPPSHRWYTVLDLKDAFFCLRLHPTSQPLFAFEWRDPGMGISGQLTWTRLPQGFKNSPTLFDEALHRDLADFRIQHPDLILLQYVDDILLAATSELDCQQGTRALLLTLGNLGYRASAKKAQLCQKQVKYLGYLLKEGQRWLTEARKETVMGQPTPKTPRQLREFLGTAGFCRLWIPGFAEMAAPLYPLTKTGTLFNWGPDQQKAYQEIKQALLTAPALGLPDLTKPFELFVDEKQGYAKGVLTQKLGPWRRPVAYLSKKLDPVAAGWPPCLRMVAAIAVLRKDAGKLTMGQPLVILAPHAVEALVKQPPDRWLSNARMTHYQAMLLDTDRVQFGPVVALNPATLLPLPEEGAPHDCLEILAETHGTRPDLTDQPIPDADHTWYTDGSSFLQEGQRKAGAAVTTETEVIWARALPAGTSAQRAELIALTQALKMAEGKRLNVYTDSRYAFATAHIHGEIYRRRGLLTSEGREIKNKSEILALLKALFLPKRLSIIHCLGHQKGDSAEARGNRLADQAAREAAIKTPPDTSTLL

SEQ ID NO: 3193 - protein, 671 aa, synthetic construct
  source 1..671: note = Description of Artificial Sequence: Synthetic polypeptide
TLNLEDEYRLYETSAEPEVSPGSTWLSDFPQAWAETGGMGLAVRQAPLIIPLKATSTPVSIKQYPMSQEAKLGIKPHIQRLLDQGILVPCQSPWNTPLLPVKKPGTNDYRPVQDLREVNKRVEDIHPTVPNPYNLLSGLPPSHRWYTVLDLKDAFFCLRLHPTSQPLFAFEWRDPGMGISGQLTWTRLPQGFKNSPTLFNEALHRDLADFRIQHPDLILLQYVDDILLAATSELDCQQGTRALLLTLGNLGYRASAKKAQLCQKQVKYLGYLLKEGQRWLTEARKETVMGQPTPKTPRQLREFLGTAGFCRLWIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLRKDAGKLTMGQPLVILAPHAVEALVKQPPDRWLSNARMTHYQAMLLDTDRVQFGPVVALNPATLLPLPEEGAPHDCLEILAETHGTRPDLTDQPIPDADHTWYTDGSSFLQEGQRKAGAAVTTETEVIWARALPAGTSAQRAELIALTQALKMAEGKRLNVYTDSRYAFATAHIHGEIYRRRGWLTSEGREIKNKSEILALLKALFLPKRLSIIHCLGHQKGDSAEARGNRLADQAAREAAIKTPPDTSTLL

SEQ ID NO: 3194 - protein, 671 aa, synthetic construct
  source 1..671: note = Description of Artificial Sequence: Synthetic polypeptide
TLNLEDEYRLYETSAEPEVSPGSTWLSDFPQAWAETGGMGLAVRQAPLIIPLKATSTPVSIKQYPMSQEAKLGIKPHIQRLLDQGILVPCQSPWNTPLLPVKKPGTNDYRPVQDLREVNKRVEDIHPTVPNPYNLLSGLPPSHRWYTVLDLKDAFFCLRLHPTSQPLFAFEWRDPGMGISGQLTWTRLPQGFKNSPTLFNEALHRDLADFRIQHPDLILLQYVDDILLAATSELDCQQGTRALLLTLGNLGYRASAKKAQLCQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLRKDAGKLTMGQPLVILAPHAVEALVKQPPDRWLSNARMTHYQAMLLDTDRVQFGPVVALNPATLLPLPEEGAPHDCLEILAETHGTRPDLTDQPIPDADHTWYTDGSSFLQEGQRKAGAAVTTETEVIWARALPAGTSAQRAELIALTQALKMAEGKRLNVYTDSRYAFATAHIHGEIYRRRGWLTSEGREIKNKSEILALLKALFLPKRLSIIHCLGHQKGDSAEARGNRLADQAAREAAIKTPPDTSTLL

SEQ ID NO: 3195 - protein, 671 aa, synthetic construct
  source 1..671: note = Description of Artificial Sequence: Synthetic polypeptide
LGIEDEYRLHETSTEPDVSLGSTWLSDFPQAWAETGGMGLAVRQAPLIIPLKATSTPVSIQQYPMSHEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPGMGISGQLTWTRLPQGFKNSPTLFNEALHRDLADFRIQHPDLILLQYVDDILLAATSELDCQQGTRALLQTLGDLGYRASAKKAQICQKQVKYLGYLLREGQRWLTEARKETVMGQPVPKTPRQLREFLGKAGFCRLFIPGFAEMAAPLYPLTKPGTLFSWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEEGAPHDCLEILAETHGTRPDLTDQPIPDADHTWYTDGSSFLQEGQRKAGAAVTTETEVIWAGALPAGTSAQRAELIALTQALKMAEGKRLNVYTDSRYAFATAHIHGEIYRRRGWLTSEGREIKNKSEILALLKALFLPKRLSIIHCLGHQKGDSAEARGNRLADQAAREAAIKTPPDTSTLLI

SEQ ID NO: 3196 - protein, 671 aa, synthetic construct
  source 1..671: note = Description of Artificial Sequence: Synthetic polypeptide
TLGIEDEYRLHETSTEPDVSLGSTWLSDFPQAWAETGGMGLAVRQAPLIIPLKATSTPVSIQQYPMSHEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPGMGISGQLTWTRLPQGFKNSPTLFDEALHRDLADFRIQHPDLILLQYVDDILLAATSELDCQQGTRALLQTLGDLGYRASAKKAQICQKQVKYLGYLLREGQRWLTEARKETVMGQPVPKTPRQLREFLGTAGFCRLWIPGFAEMAAPLYPLTKTGTLFSWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEEGAPHDCLEILAETHGTRPDLTDQPIPDADHTWYTDGSSFLQEGQRKAGAAVTTETEVIWAGALPAGTSAQRAELIALTQALKMAEGKRLNVYTDSRYAFATAHIHGEIYRRRGLLTSEGREIKNKSEILALLKALFLPKRLSIIHCLGHQKGDSAEARGNRLADQAAREAAIKTPPDTSTLL

SEQ ID NO: 3197 - protein, 671 aa, synthetic construct
  source 1..671: note = Description of Artificial Sequence: Synthetic polypeptide
TLGIEDEYRLHETSTEPDVSLGSTWLSDFPQAWAETGGMGLAVRQAPLIIPLKATSTPVSIQQYPMSHEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPGMGISGQLTWTRLPQGFKNSPTLFNEALHRDLADFRIQHPDLILLQYVDDILLAATSELDCQQGTRALLQTLGDLGYRASAKKAQICQKQVKYLGYLLREGQRWLTEARKETVMGQPVPKTPRQLREFLGTAGFCRLWIPGFAEMAAPLYPLTKPGTLFSWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEEGAPHDCLEILAETHGTRPDLTDQPIPDADHTWYTDGSSFLQEGQRKAGAAVTTETEVIWAGALPAGTSAQRAELIALTQALKMAEGKRLNVYTDSRYAFATAHIHGEIYRRRGWLTSEGREIKNKSEILALLKALFLPKRLSIIHCLGHQKGDSAEARGNRLADQAAREAAIKTPPDTSTLL

SEQ ID NO: 3198 - protein, 671 aa, synthetic construct
  source 1..671: note = Description of Artificial Sequence: Synthetic polypeptide
TLNIEDEYRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFDEALHRDLAGFRIQHPDLILLQYVDDLLLAATSELDCQQGTRALLQTLGDLGYRASAKKAQICQKQVKYLGYLLKEGQRWLTEARKETVMGQPIPKTPRQLREFLGTAGFCRLWIPGFAEMAAPLYPLTKTGTLFNWGPDQQKAFQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHDCLDILAEAHGTRSDLMDQPLPDADHTWYTDGSSFLQEGQRKAGAAVTTETEVIWARALPAGTSAQRAELIALTQALKMAEGKKLNVYTDSRYAFATAHIHGEIYRRRGLLTSEGKEIKNKDEILALLKALFLPKRLSIIHCPGHQKGNSAEARGNRMADQAAREVATRETPETSTLL

SEQ ID NO: 3199 - protein, 671 aa, synthetic construct
  source 1..671: note = Description of Artificial Sequence: Synthetic polypeptide
TLNIEDEYRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLAGFRIQHPDLILLQYVDDLLLAATSELDCQQGTRALLQTLGDLGYRASAKKAQICQKQVKYLGYLLKEGQRWLTEARKETVMGQPIPKTPRQLREFLGTAGFCRLWIPGFAEMAAPLYPLTKPGTLFNWGPDQQKAFQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHDCLDILAEAHGTRSDLMDQPLPDADHTWYTDGSSFLQEGQRKAGAAVTTETEVIWARALPAGTSAQRAELIALTQALKMAEGKKLNVYTDSRYAFATAHIHGEIYRRRGWLTSEGKEIKNKDEILALLKALFLPKRLSIIHCPGHQKGNSAEARGNRMADQAAREVATRETPETSTLL

SEQ ID NO: 3200 - protein, 671 aa, synthetic construct
  source 1..671: note = Description of Artificial Sequence: Synthetic polypeptide
TLNIEDEYRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLAGFRIQHPDLILLQYVDDLLLAATSELDCQQGTRALLQTLGDLGYRASAKKAQICQKQVKYLGYLLKEGQRWLTEARKETVMGQPIPKTPRQLREFLGKAGFCRLFIPGFAEMAAPLYPLTKPGTLFNWGPDQQKAFQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHDCLDILAEAHGTRSDLMDQPLPDADHTWYTDGSSFLQEGQRKAGAAVTTETEVIWARALPAGTSAQRAELIALTQALKMAEGKKLNVYTDSRYAFATAHIHGEIYRRRGWLTSEGKEIKNKDEILALLKALFLPKRLSIIHCPGHQKGNSAEARGNRMADQAAREVATRETPETSTLL

SEQ ID NO: 3201 - protein, 671 aa, synthetic construct
  source 1..671: note = Description of Artificial Sequence: Synthetic polypeptide
TLNIEDEYRLHETSKGPDVPLGSTWLSDFPQAWAETGGMGLAFRQAPLIISLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQSLFAFEWKDPEMGISGQLTWTRLPQGFKNSPTLFDEALHRDLADFRIQHPDLILLQYVDDLLLAATSELDCQQGTRALLQTLGDLGYRASAKKAQICQKQVKYLGYLLKEGQRWLTEARKETVMGQPTPKTPRQLREFLGTAGLCRLWIPGFAEMAAPLYPLTKTGTLFKWGPDQQKAYQEIKQALLTAPALGLPDLTKPFELFVDEKQGYAKGVLTQKLGPWRRPVAYLSKKLDPVAAGWPPCLRMVAAIAVLTKDVGKLTMGQPLVILAPHAVEALVKQPPDRWLSNARMTHYQALLLDTDRVQFGPIVALNPATLLPLPEEGLQHDCLDILAEAHGTRPDLTDQPLPDADHTWYTDGSSFLQEGQRRAGAAVTTETEVIWAKALPAGTSAQRAELIALTQALKMAAGKKLNVYTDSRYAFATAHIHGEIYRRRGLLTSEGKEIKNKDEILALLKALFLPKRLSIIHCPGHQKGNHAEARGNRMADQAAREVATRETPETSTLL

SEQ ID NO: 3202 - protein, 671 aa, synthetic construct
  source 1..671: note = Description of Artificial Sequence: Synthetic polypeptide
TLNIEDEYRLHETSKGPDVPLGSTWLSDFPQAWAETGGMGLAFRQAPLIISLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQSLFAFEWKDPEMGISGQLTWTRLPQGFKNSPTLFNEALHRDLADFRIQHPDLILLQYVDDLLLAATSELDCQQGTRALLQTLGDLGYRASAKKAQICQKQVKYLGYLLKEGQRWLTEARKETVMGQPTPKTPRQLREFLGTAGLCRLWIPGFAEMAAPLYPLTKPGTLFKWGPDQQKAYQEIKQALLTAPALGLPDLTKPFELFVDEKQGYAKGVLTQKLGPWRRPVAYLSKKLDPVAAGWPPCLRMVAAIAVLTKDVGKLTMGQPLVILAPHAVEALVKQPPDRWLSNARMTHYQALLLDTDRVQFGPIVALNPATLLPLPEEGLQHDCLDILAEAHGTRPDLTDQPLPDADHTWYTDGSSFLQEGQRRAGAAVTTETEVIWAKALPAGTSAQRAELIALTQALKMAAGKKLNVYTDSRYAFATAHIHGEIYRRRGWLTSEGKEIKNKDEILALLKALFLPKRLSIIHCPGHQKGNHAEARGNRMADQAAREVATRETPETSTLL

SEQ ID NO: 3203 - protein, 671 aa, synthetic construct
  source 1..671: note = Description of Artificial Sequence: Synthetic polypeptide
TLNIEDEYRLHETSKGPDVPLGSTWLSDFPQAWAETGGMGLAFRQAPLIISLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQSLFAFEWKDPEMGISGQLTWTRLPQGFKNSPTLFNEALHRDLADFRIQHPDLILLQYVDDLLLAATSELDCQQGTRALLQTLGDLGYRASAKKAQICQKQVKYLGYLLKEGQRWLTEARKETVMGQPTPKTPRQLREFLGKAGLCRLFIPGFAEMAAPLYPLTKPGTLFKWGPDQQKAYQEIKQALLTAPALGLPDLTKPFELFVDEKQGYAKGVLTQKLGPWRRPVAYLSKKLDPVAAGWPPCLRMVAAIAVLTKDVGKLTMGQPLVILAPHAVEALVKQPPDRWLSNARMTHYQALLLDTDRVQFGPIVALNPATLLPLPEEGLQHDCLDILAEAHGTRPDLTDQPLPDADHTWYTDGSSFLQEGQRRAGAAVTTETEVIWAKALPAGTSAQRAELIALTQALKMAAGKKLNVYTDSRYAFATAHIHGEIYRRRGWLTSEGKEIKNKDEILALLKALFLPKRLSIIHCPGHQKGNHAEARGNRMADQAAREVATRETPETSTLL

SEQ ID NO: 3204 - protein, 671 aa, synthetic construct
  source 1..671: note = Description of Artificial Sequence: Synthetic polypeptide
TLNIEDEYRLHETSKGPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQSLFAFEWRDPEMGISGQLTWTRLPQGFKNSPTLFDEALHRDLADFRIQHPDLILLQYVDDLLLAATSELDCQQGTRALLQTLGDLGYRASAKKAQICQKQVKYLGYLLKEGQRWLTEARKETVMGQPTPKTPRQLREFLGTAGFCRLWIPGFAEMAAPLYPLTKTGTLFEWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPIVALNPATLLPLPEEGLQHDCLDILAEAHGTRPDLTDQPLPDADHTWYTDGSSFLQEGQRKAGAAVTTETEVVWAKALPAGTSAQRAELIALTQALKMAEGKKLNVYTDSRYAFATAHIHGEIYRRRGLLTSEGKEIKNKDEILALLKALFLPKRLSIIHCPGHQKGNRAEARGNRMADQAAREVATRETPETSTLL

SEQ ID NO: 3205 - protein, 671 aa, synthetic construct
  source 1..671: note = Description of Artificial Sequence: Synthetic polypeptide
TLNIEDEYRLHETSKGPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQSLFAFEWRDPEMGISGQLTWTRLPQGFKNSPTLFNEALHRDLADFRIQHPDLILLQYVDDLLLAATSELDCQQGTRALLQTLGDLGYRASAKKAQICQKQVKYLGYLLKEGQRWLTEARKETVMGQPTPKTPRQLREFLGTAGFCRLWIPGFAEMAAPLYPLTKPGTLFEWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPIVALNPATLLPLPEEGLQHDCLDILAEAHGTRPDLTDQPLPDADHTWYTDGSSFLQEGQRKAGAAVTTETEVVWAKALPAGTSAQRAELIALTQALKMAEGKKLNVYTDSRYAFATAHIHGEIYRRRGWLTSEGKEIKNKDEILALLKALFLPKRLSIIHCPGHQKGNRAEARGNRMADQAAREVATRETPETSTLL

SEQ ID NO: 3206 - protein, 671 aa, synthetic construct
  source 1..671: note = Description of Artificial Sequence: Synthetic polypeptide
TLNIEDEYRLHETSKGPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQSLFAFEWRDPEMGISGQLTWTRLPQGFKNSPTLFNEALHRDLADFRIQHPDLILLQYVDDLLLAATSELDCQQGTRALLQTLGDLGYRASAKKAQICQKQVKYLGYLLKEGQRWLTEARKETVMGQPTPKTPRQLREFLGKAGFCRLFIPGFAEMAAPLYPLTKPGTLFEWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPIVALNPATLLPLPEEGLQHDCLDILAEAHGTRPDLTDQPLPDADHTWYTDGSSFLQEGQRKAGAAVTTETEVVWAKALPAGTSAQRAELIALTQALKMAEGKKLNVYTDSRYAFATAHIHGEIYRRRGWLTSEGKEIKNKDEILALLKALFLPKRLSIIHCPGHQKGNRAEARGNRMADQAAREVATRETPETSTLL

SEQ ID NO: 3207 - protein, 691 aa, synthetic construct
  source 1..691: note = Description of Artificial Sequence: Synthetic polypeptide
TLNIEDEYRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGWLTSEGKEIKNKDEILALLKALFLPKRLSIIHCPGHQKGHSAEARGNRMADQAARKAAITETPDTSTLLIENSSPSGGSKRTADGSEFE

SEQ ID NO: 3208 - protein, 671 aa, synthetic construct
  source 1..671: note = Description of Artificial Sequence: Synthetic polypeptide
TLNIEDEHRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGTAGFCRLWIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGWLTSEGKEIKNKDEILALLKALFLPKRLSIIHCPGHQKGHSAEARGNRMADQAARKAAITETPDTSTLL

SEQ ID NO: 3209 - protein, 671 aa, synthetic construct
  source 1..671: note = Description of Artificial Sequence: Synthetic polypeptide
TLNIEDEHRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGWLTSEGKEIKNKDEILALLKALFLPKRLSIIHCPGHQKGHSAEARGNRMADQAARKAAITETPDTSTLL

SEQ ID NO: 3210 - protein, 671 aa, synthetic construct
  source 1..671: note = Description of Artificial Sequence: Synthetic polypeptide
TLNIEDEYRLHEISTEPDVSPGSTWLSDFPQAWAETGGMGLAVRQAPLIIPLKATSTPVSIKQYPMSQEAKLGIKPHIQRLLDQGILVPCQSPWNTPLLPVKKPGTNDYRPVQGLREVNKRVEDIHPTVPNPYNLLSGLPTSHRWYTVLDLKDAFFCLRLHPTSQPLFASEWRDPGMGISGQLTWTRLPQGFKNSPTLFDEALHRGLADFRIQHPDLILLQYVDDLLLAATSELDCQQGTRALLKTLGNLGYRASAKKAQICQKQVKYLGYLLREGQRWLTEARKETVMGQPTPKTPRQLREFLGTAGFCRLWIPRFAEMAAPLYPLTKTGTLFNWGPDQQKAYHEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEEGAPHDCLEILAETHGTEPDLTDQPIPDADHTWYTDGSSFLQEGQRKAGAAVTTETEVIWARALPAGTSAQRAELIALTQALKMAEGKRLNVYTDSRYAFATAHIHGEIYKRRGLLTSEGREIKNKSEILALLKALFLPKRLSIIHCLGHQKGDSAEARGNRLADQAAREAAIKTPPDTSTLL

SEQ ID NO: 3211 - protein, 671 aa, synthetic construct
  source 1..671: note = Description of Artificial Sequence: Synthetic polypeptide
TLNIEDEYRLHEISTEPDVSPGSTWLSDFPQAWAETGGMGLAVRQAPLIIPLKATSTPVSIKQYPMSQEAKLGIKPHIQRLLDQGILVPCQSPWNTPLLPVKKPGTNDYRPVQGLREVNKRVEDIHPTVPNPYNLLSGLPTSHRWYTVLDLKDAFFCLRLHPTSQPLFASEWRDPGMGISGQLTWTRLPQGFKNSPTLFNEALHRGLADFRIQHPDLILLQYVDDLLLAATSELDCQQGTRALLKTLGNLGYRASAKKAQICQKQVKYLGYLLREGQRWLTEARKETVMGQPTPKTPRQLREFLGTAGFCRLWIPRFAEMAAPLYPLTKPGTLFNWGPDQQKAYHEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEEGAPHDCLEILAETHGTEPDLTDQPIPDADHTWYTDGSSFLQEGQRKAGAAVTTETEVIWARALPAGTSAQRAELIALTQALKMAEGKRLNVYTDSRYAFATAHIHGEIYKRRGWLTSEGREIKNKSEILALLKALFLPKRLSIIHCLGHQKGDSAEARGNRLADQAAREAAIKTPPDTSTLL

SEQ ID NO: 3212 - protein, 671 aa, synthetic construct
  source 1..671: note = Description of Artificial Sequence: Synthetic polypeptide
TLNIEDEYRLHEISTEPDVSPGSTWLSDFPQAWAETGGMGLAVRQAPLIIPLKATSTPVSIKQYPMSQEAKLGIKPHIQRLLDQGILVPCQSPWNTPLLPVKKPGTNDYRPVQGLREVNKRVEDIHPTVPNPYNLLSGLPTSHRWYTVLDLKDAFFCLRLHPTSQPLFASEWRDPGMGISGQLTWTRLPQGFKNSPTLFNEALHRGLADFRIQHPDLILLQYVDDLLLAATSELDCQQGTRALLKTLGNLGYRASAKKAQICQKQVKYLGYLLREGQRWLTEARKETVMGQPTPKTPRQLREFLGKAGFCRLFIPRFAEMAAPLYPLTKPGTLFNWGPDQQKAYHEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEEGAPHDCLEILAETHGTEPDLTDQPIPDADHTWYTDGSSFLQEGQRKAGAAVTTETEVIWARALPAGTSAQRAELIALTQALKMAEGKRLNVYTDSRYAFATAHIHGEIYKRRGWLTSEGREIKNKSEILALLKALFLPKRLSIIHCLGHQKGDSAEARGNRLADQAAREAAIKTPPDTSTLL

SEQ ID NO: 3213 - protein, 691 aa, synthetic construct
  source 1..691: note = Description of Artificial Sequence: Synthetic polypeptide
VQEISDSRPMLHIYLNGRRFLGLLDTGADKTCIAGRDWPANWPIHQTESSLQGLGMACGVARSSQPLRWQHEDKSGIIHPFVIPTLPFTLWGRDIMKDIKVRLMTDSPDDSQDLMIGAIESNLFADQISWKSDQPVWLNQWPLKQEKLQALQQLVTEQLQLGHLEESNSPWNTPVFVIKKKSGKWRLLQDLRAVNATMHDMGALQPGLPSPVAVPKGWEIIIIDLQDCFFNIKLHPEDCKRFAFSVPSPNFKRPYQRFQWKVLPQGMKNSPTLCQKFVDKAILTVRDKYQDSYIVHYMDDILLAHPSRSIVDEILTSMIQALNKHGLVVSTEKIQKYDNLKYLGTHIQGDSVSYQKLQIRTDKLRTLNDFQKLLGNINWIRPFLKLTTGELKPLFEILNGDSNPISTRKLTPEACKALQLMNERLSTARVKRLDLSQPWSLCILKTEYTPTACLWQDGVVEWIHLPHISPKVITPYDIFCTQLIIKGRHRSKELFSKDPDYIVVPYTKVQFDLLLQEKEDWPISLLGFLGEVHFHLPKDPLLTFTLQTAIIFPHMTSTTPLEKGIVIFTDGSANGRSVTYIQGREPIIKENTQNTAQQAEIVAVITAFEEVSQPFNLYTDSKYVTGLFPEIETATLSPRTKIYTELKHLQRLIHKRQEKFYIGHIRGHTGLPGPLAQGNAYADSLTRILTA

SEQ ID NO: 3214 - protein, 691 aa, synthetic construct
  source 1..691: note = Description of Artificial Sequence: Synthetic polypeptide
WVQEISDSRPMLHIYLNGRRFLGLLNTGADKTCIAGRDWPANWPIHQTESSLQGLGMACGVARSSQPLRWQHEDKSGIIHPFVIPTLPFTLWGRDIMKDIKVRLMTDSPDDSQDLMIGAIESNLFADQISWKSDQPVWLNQWPLKQEKLQALQQLVTEQLQLGHLEESNSPWNTPVFVIKKKSGKWRLLQDLRAVNATMHDMGALQPGLPSPVAVPKGWEIIIIDLQDCFFNIKLHPEDCKRFAFSVPSPNFKRPYQRFQWKVLPQGMKNSPTLCQKFVDKAILTVRDKYQDSYIVHYMDDILLAHPSRSIVDEILTSMIQALNKHGLVVSTEKIQKYDNLKYLGTHIQGDSVSYQKLQIRTDKLRTLNDFQKLLGNINWIRPFLKLTTGELKPLFEILNGDSNPISTRKLTPEACKALQLMNERLSTARVKRLDLSQPWSLCILKTEYTPTACLWQDGVVEWIHLPHISPKVITPYDIFCTQLIIKGRHRSKELFSKDPDYIVVPYTKVQFDLLLQEKEDWPISLLGFLGEVHFHLPKDPLLTFTLQTAIIFPHMTSTTPLEKGIVIFTDGSANGRSVTYIQGREPIIKENTQNTAQQAEIVAVITAFEEVSQPFNLYTDSKYVTGLFPEIETATLSPRTKIYTELKHLQRLIHKRQEKFYIGHIRGHTGLPGPLAQGNAYADSLTRILT

SEQ ID NO: 3215 - protein, 599 aa, synthetic construct
  source 1..599: note = Description of Artificial Sequence: Synthetic polypeptide
GRDIMKDIKVRLMTDSPDDSQDLMIGAIESNLFADQISWKSDQPVWLNQWPLKQEKLQALQQLVTEQLQLGHLEESNSPWNTPVFVIKKKSGKWRLLQDLRAVNATMHDMGALQPGLPSPVAVPKGWEIIIIDLQDCFFNIKLHPEDCKRFAFSVPSPNFKRPYQRFQWKVLPQGMKNSPTLCQKFVDKAILTVRDKYQDSYIVHYMDDILLAHPSRSIVDEILTSMIQALNKHGLVVSTEKIQKYDNLKYLGTHIQGDSVSYQKLQIRTDKLRTLNDFQKLLGNINWIRPFLKLTTGELKPLFEILNGDSNPISTRKLTPEACKALQLMNERLSTARVKRLDLSQPWSLCILKTEYTPTACLWQDGVVEWIHLPHISPKVITPYDIFCTQLIIKGRHRSKELFSKDPDYIVVPYTKVQFDLLLQEKEDWPISLLGFLGEVHFHLPKDPLLTFTLQTAIIFPHMTSTTPLEKGIVIFTDGSANGRSVTYIQGREPIIKENTQNTAQQAEIVAVITAFEEVSQPFNLYTDSKYVTGLFPEIETATLSPRTKIYTELKHLQRLIHKRQEKFYIGHIRGHTGLPGPLAQGNAYADSLTRILT

SEQ ID NO: 3216 - protein, 599 aa, synthetic construct
  source 1..599: note = Description of Artificial Sequence: Synthetic polypeptide
GRDIMKDIKVRLMTDSPDDSQDLMIGAIESNLFADQISWKSDQPVWLNQWPLKQEKLQALQQLVTEQLQLGHLEESNSPWNTPVFVIKKKSGKWRLLQDLRAVNATMHDMGALQPGLPSPVAVPKGWEIIIIDLQDCFFNIKLHPEDCKRFAFSVPSPNFKRPYQRFQWKVLPQGMKNSPTLCQKFVDKAILTVRDKYQDSYIVHYMDDILLAHPSRSIVDEILTSMIQALNKHGLVVSTEKIQKYDNLKYLGTHIQGDSVSYQKLQIRTDKLRTLNDFQKLLGNINWIRPFLKLTTGELKPLFEILNPDSNPISTRKLTPEACKALQLMNERLSTARVKRLDLSQPWSLCILKTEYTPTACLWQDGVVEWIHLPHISPKVITPYDIFCTQLIIKGRHRSKELFSKDPDYIVVPYTKVQFDLLLQEKEDWPISLLGFLGEVHFHLPKDPLLTFTLQTAIIFPHMTSTTPLEKGIVIFTDGSANGRSVTYIQGREPIIKENTQNTAQQAEIVAVITAFEEVSQPFNLYTDSKYVTGLFPEIETATLSPRTKIYTELKHLQRLIHKRQEKFYIGHIRGHTGLPGPLAQGNAYADSLTRILT

SEQ ID NO: 3217 - protein, 599 aa, synthetic construct
  source 1..599: note = Description of Artificial Sequence: Synthetic polypeptide
GRDIMKDIKVRLMTDSPDDSQDLMIGAIESNLFADQISWKSDQPVWLNQWPLKQEKLQALQQLVTEQLQLGHLEESNSPWNTPVFVIKKKSGKWRLLQDLRAVNATMHDMGALQPGLPSPVAPPKGWEIIIIDLQDCFFNIKLHPEDCKRFAFSVPSPNFKRPYQRFQWKVLPQGMKNSPTLCQKFVDKAILTVRDKYQDSYIVHYMDDILLAHPSRSIVDEILTSMIQALNKHGLVVSTEKIQKYDNLKYLGTHIQGDSVSYQKLQIRTDKLRTLNDFQKLLGNINWIRPFLKLTTGELKPLFEILNPDSNPISTRKLTPEACKALQLMNERLSTARVKRLDLSQPWSLCILKTEYTPTACLWQDGVVEWIHLPHISPKVITPYDIFCTQLIIKGRHRSKELFSKDPDYIVVPYTKVQFDLLLQEKEDWPISLLGFLGEVHFHLPKDPLLTFTLQTAIIFPHMTSTTPLEKGIVIFTDGSANGRSVTYIQGREPIIKENTQNTAQQAEIVAVITAFEEVSQPFNLYTDSKYVTGLFPEIETATLSPRTKIYTELKHLQRLIHKRQEKFYIGHIRGHTGLPGPLAQGNAYADSLTRILT

SEQ ID NO: 3218 - protein, 691 aa, synthetic construct
  source 1..691: note = Description of Artificial Sequence: Synthetic polypeptide
WVQEISDSRPMLHIYLNGRRFLGLLNTGADKTCIAGRDWPANWPIHQTESSLQGLGMACGVARSSQPLRWQHEDKSGIIHPFVIPTLPFTLWGRDIMKDIKVRLMTDSPDDSQDLMIGAIESNLFADQISWKSDQPVWLNQWPLKQEKLQALQQLVTEQLQLGHLEESNSPWNTPVFVIKKKSGKWRLLQDLRAVNATMHDMGALQPGLPSPVAVPKGWEIIIIDLQDCFFNIKLHPEDCKRFAFSVPSPNFKRPYQRFQWKVLPQGMKNSPTLCQKFVDKAILTVRDKYQDSYIVHYMDDILLAHPSRSIVDEILTSMIQALNKHGLVVSTEKIQKYDNLKYLGTHIQGDSVSYQKLQIRTDKLRTLNDFQKLLGNINWIRPFLKLTTGELKPLFEILNPDSNPISTRKLTPEACKALQLMNERLSTARVKRLDLSQPWSLCILKTEYTPTACLWQDGVVEWIHLPHISPKVITPYDIFCTQLIIKGRHRSKELFSKDPDYIVVPYTKVQFDLLLQEKEDWPISLLGFLGEVHFHLPKDPLLTFTLQTAIIFPHMTSTTPLEKGIVIFTDGSANGRSVTYIQGREPIIKENTQNTAQQAEIVAVITAFEEVSQPFNLYTDSKYVTGLFPEIETATLSPRTKIYTELKHLQRLIHKRQEKFYIGHIRGHTGLPGPLAQGNAYADSLTRILT

SEQ ID NO: 3219 - protein, 691 aa, synthetic construct
  source 1..691: note = Description of Artificial Sequence: Synthetic polypeptide
WVQEISDSRPMLHIYLNGRRFLGLLNTGADKTCIAGRDWPANWPIHQTESSLQGLGMACGVARSSQPLRWQHEDKSGIIHPFVIPTLPFTLWGRDIMKDIKVRLMTDSPDDSQDLMIGAIESNLFADQISWKSDQPVWLNQWPLKQEKLQALQQLVTEQLQLGHLEESNSPWNTPVFVIKKKSGKWRLLQDLRAVNATMHDMGALQPGLPSPVAPPKGWEIIIIDLQDCFFNIKLHPEDCKRFAFSVPSPNFKRPYQRFQWKVLPQGMKNSPTLCQKFVDKAILTVRDKYQDSYIVHYMDDILLAHPSRSIVDEILTSMIQALNKHGLVVSTEKIQKYDNLKYLGTHIQGDSVSYQKLQIRTDKLRTLNDFQKLLGNINWIRPFLKLTTGELKPLFEILNPDSNPISTRKLTPEACKALQLMNERLSTARVKRLDLSQPWSLCILKTEYTPTACLWQDGVVEWIHLPHISPKVITPYDIFCTQLIIKGRHRSKELFSKDPDYIVVPYTKVQFDLLLQEKEDWPISLLGFLGEVHFHLPKDPLLTFTLQTAIIFPHMTSTTPLEKGIVIFTDGSANGRSVTYIQGREPIIKENTQNTAQQAEIVAVITAFEEVSQPFNLYTDSKYVTGLFPEIETATLSPRTKIYTELKHLQRLIHKRQEKFYIGHIRGHTGLPGPLAQGNAYADSLTRILT

SEQ ID NO: 3220 - protein, 691 aa, synthetic construct
  source 1..691: note = Description of Artificial Sequence: Synthetic polypeptide
VQEISDSRPMLHIYLNGRRFLGLLDTGADKTCIAGRDWPANWPIHQTESSLQGLGMACGVARSSQPLRWQHEDKSGIIHPFVIPTLPFTLWGRDIMKDIKVRLMTDSPDDSQDLMIGAIESNLFADQISWKSDQPVWLNQWPLKQEKLQALQQLVTEQLQLGHLEESNSPWNTPVFVIKKKSGKWRLLQDLRAVNATMHDMGALQPGLPSPPAVPKGWEIIIIDLQDCFFNIKLHPEDCKRFAFSVPSPNFKRPYQRFQWKVLPQGMKNSPTLCQKFVDKAILTVRDKYQDSYIVHYMDDILLAHPSRSIVDEILTSMIQALNKHGLVVSTEKIQKYDNLKYLGTHIQGDSVSYQKLQIRTDKLRTLNDFQKLLGNINWIRPFLKLTTGELKPLFEILNPDSNPISTRKLTPEACKALQLMNERLSTARVKRLDLSQPWSLCILKTEYTPTACLWQDGVVEWIHLPHISPKVITPYDIFCTQLIIKGRHRSKELFSKDPDYIVVPYTKVQFDLLLQEKEDWPISLLGFLGEVHFHLPKDPLLTFTLQTAIIFPHMTSTTPLEKGIVIFTDGSANGRSVTYIQGREPIIKENTQNTAQQAEIVAVITAFEEVSQPFNLYTDSKYVTGLFPEIETATLSPRTKIYTELKHLQRLIHKRQEKFYIGHIRGHTGLPGPLAQGNAYADSLTRILTA

SEQ ID NO: 3221 - protein, 691 aa, synthetic construct
  source 1..691: note = Description of Artificial Sequence: Synthetic polypeptide
VQEISDSRPMLHIYLNGRRFLGLLDTGADKTCIAGRDWPANWPIHQTESSLQGLGMACGVARSSQPLRWQHEDKSGIIHPFVIPTLPFTLWGRDIMKDIKVRLMTDSPDDSQDLMIGAIESNLFADQISWKSDQPVWLNQWPLKQEKLQALQQLVTEQLQLGHLEESNSPWNTPVFVIKKKSGKWRLLQDLRAVNATMHDMGALQPGLPSPVAVPKGWEIIIIDLQDCFFNIKLHPEDCKRFAFSVPSPNFKRPYQRFQWKVLPQGMKNSPTLCQKFVDKAILTVRDKYQDSYIVHYMDDILLAHPSRSIVDEILTSMIQALNKHGLVVSTEKIQKYDNLKYLGTHIQGDSVSYQKLQIRTDKLRTLNDFQKLLGNINWIRPFLKLTTGELKPLFEILNPDSNPISTRKLTPEACKALQLMNERLSTARVKRLDLSQPWSLCILKTEYTPTACLWQDGVVEWIHLPHISPKVITPYDIFCTQLIIKGRHRSKELFSKDPDYIVVPYTKVQFDLLLQEKEDWPISLLGFLGEVHFHLPKDPLLTFTLQTAIIFPHMTSTTPLEKGIVIFTDGSANGRSVTYIQGREPIIKENTQNTAQQAEIVAVITAFEEVSQPFNLYTDSKYVTGLFPEIETATLSPRTKIYTELKHLQRLIHKRQEKFYIGHIRGHTGLPGPLAQGNAYADSLTRILTA

SEQ ID NO: 3222 - protein, 585 aa, synthetic construct
  source 1..585: note = Description of Artificial Sequence: Synthetic polypeptide
LTAAIDILAPQQCAEPITWKSDEPVWVDQWPLTNDKLAAAQQLVQEQLEAGHITESSSPWNTPIFVIKKKSGKWRLLQDLRAVNATMVLMGALQPGLPSPVAIPQGYLKIIIDLKDCFFSIPLHPSDQKRFAFSLPSTNFKEPMQRFQWKVLPQGMANSPTLCQKYVATAIHKVRHAWKQMYIIHYMDDILIAGKDGQQVLQCFDQLKQELTAAGLHIAPEKVQLQDPYTYLGFELNGPKITNQKAVIRKDKLQTLNDFQKLLGDINWLRPYLKLTTGDLKPLFDTLKGDSDPNSHRSLSKEALASLEKVETAIAEQFVTHINYSLPLIFLIFNTALTPTGLFWQDNPIMWIHLPASPKKVLLPYYDAIADLIILGRDHSKKYFGIEPSTIIQPYSKSQIDWLMQNTEMWPIACASFVGILDNHYPPNKLIQFCKLHTFVFPQIISKTPLNNALLVFTDGSSTGMAAYTLTDTTIKFQTNLNSAQLVELQALIAVLSAFPNQPLNIYTDSAYLAHSIPLLETVAQIKHISETAKLFLQCQQLIYNRSIPFYIGHVRAHSGLPGPIAQGNQRADLATKIVASNINT

SEQ ID NO: 3223 - protein, 585 aa, synthetic construct
  source 1..585: note = Description of Artificial Sequence: Synthetic polypeptide
LTAAIDILAPQQCAEPITWKSDEPVWVDQWPLTNDKLAAAQQLVQEQLEAGHITESSSPWNTPIFVIKKKSGKWRLLQDLRAVNATMVLMGALQPGLPSPVAIPQGYLKIIIDLKDCFFSIPLHPSDQKRFAFSLPSTNFKEPMQRFQWKVLPQGMANSPTLCQKYVATAIHKVRHAWKQMYIIHYMDDILIAGKDGQQVLQCFDQLKQELTAAGLHIAPEKVQLQDPYTYLGFELNGPKITNQKAVIRKDKLQTLNDFQKLLGDINWLRPYLKLTTGDLKPLFDTLKPDSDPNSHRSLSKEALASLEKVETAIAEQFVTHINYSLPLIFLIFNTALTPTGLFWQDNPIMWIHLPASPKKVLLPYYDAIADLIILGRDHSKKYFGIEPSTIIQPYSKSQIDWLMQNTEMWPIACASFVGILDNHYPPNKLIQFCKLHTFVFPQIISKTPLNNALLVFTDGSSTGMAAYTLTDTTIKFQTNLNSAQLVELQALIAVLSAFPNQPLNIYTDSAYLAHSIPLLETVAQIKHISETAKLFLQCQQLIYNRSIPFYIGHVRAHSGLPGPIAQGNQRADLATKIVASNINT

SEQ ID NO: 3224 - protein, 585 aa, synthetic construct
  source 1..585: note = Description of Artificial Sequence: Synthetic polypeptide
LTAAIDILAPQQCAEPITWKSDEPVWVDQWPLTNDKLAAAQQLVQEQLEAGHITESSSPWNTPIFVIKKKSGKWRLLQDLRAVNATMVLMGALQPGLPSPVAPPQGYLKIIIDLKDCFFSIPLHPSDQKRFAFSLPSTNFKEPMQRFQWKVLPQGMANSPTLCQKYVATAIHKVRHAWKQMYIIHYMDDILIAGKDGQQVLQCFDQLKQELTAAGLHIAPEKVQLQDPYTYLGFELNGPKITNQKAVIRKDKLQTLNDFQKLLGDINWLRPYLKLTTGDLKPLFDTLKPDSDPNSHRSLSKEALASLEKVETAIAEQFVTHINYSLPLIFLIFNTALTPTGLFWQDNPIMWIHLPASPKKVLLPYYDAIADLIILGRDHSKKYFGIEPSTIIQPYSKSQIDWLMQNTEMWPIACASFVGILDNHYPPNKLIQFCKLHTFVFPQIISKTPLNNALLVFTDGSSTGMAAYTLTDTTIKFQTNLNSAQLVELQALIAVLSAFPNQPLNIYTDSAYLAHSIPLLETVAQIKHISETAKLFLQCQQLIYNRSIPFYIGHVRAHSGLPGPIAQGNQRADLATKIVASNINT

SEQ ID NO: 3225 - protein, 663 aa, synthetic construct
  source 1..663: note = Description of Artificial Sequence: Synthetic polypeptide
LDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLP

SEQ ID NO: 3226 - protein, 665 aa, synthetic construct
  source 1..665: note = Description of Artificial Sequence: Synthetic polypeptide
TLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFDEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKEKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGLLTSAGREIKNKEEILSLLEALHLPKRLAIIHCPGHQKAKDPISRGNQMADRVAKQAAQGVNLL

SEQ ID NO: 3227 - protein, 665 aa, synthetic construct
  source 1..665: note = Description of Artificial Sequence: Synthetic polypeptide
TLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLL

SEQ ID NO: 3228 - protein, 751 aa, synthetic construct
  source 1..751: note = Description of Artificial Sequence: Synthetic polypeptide
MDPLQLLQPLEAEIKGTKLKAHWNSGATITCVPEAFLEDERPIQTMLIKTIHGEKQQDVYYLTFKVQGRKVEAEVLASPYDYILLNPSDVPWLMKKPLQLTVLVPLHEYQERLLQQTALPKEQKELLQKLFLKYDALWQHWENQVGHRRIKPHNIATGTLAPRPQKQYPINPKAKPSIQIVIDDLLKQGVLIQQNSTMNTPVYPVPKPDGKWRMVLDYREVNKTIPLIAAQNQHSAGILSSIYRGKYKTTLDLTNGFWAHPITPESYWLTAFTWQGKQYCWTRLPQGFLNSPALFTADVVDLLKEIPNVQAYVDDIYISHDDPQEHLEQLEKIFSILLNAGYVVSLKKSEIAQREVEFLGFNITKEGRGLTDTFKQKLLNITPPKDLKQLQSILGLLNFARNFIPNYSELVKPLYTIVANANGKFISWTEDNSNQLQHIISVLNQADNLEERNPETRLIIKVNSSPSAGYIRYYNEGSKRPIMYVNYIFSKAEAKFTQTEKLLTTMHKGLIKAMDLAMGQEILVYSPIVSMTKIQRTPLPERKALPVRWITWMTYLEDPRIQFHYDKSLPELQQIPNVTEDVIAKTKHPSEFAMVFYTDGSAIKHPDVNKSHSAGMGIAQVQFIPEYKIVHQWSIPLGDHTAQLAEIAAVEFACKKALKISGPVLIVTDSFYVAESANKELPYWKSNGFLNNKKKPLRHVSKWKSIAECLQLKPDIIIMHEKGHQQPMTTLHTEGNNLADKLATQGSYVVH

SEQ ID NO: 3229 - protein, 662 aa, synthetic construct
  source 1..662: note = Description of Artificial Sequence: Synthetic polypeptide
VPWLMKKPLQLTVLVPLHEYQERLLQQTALPKEQKELLQKLFLKYDALWQHWENQVGHRRIKPHNIATGTLAPRPQKQYPINPKAKPSIQIVIDDLLKQGVLIQQNSTMNTPVYPVPKPDGKWRMVLDYREVNKTIPLIAAQNQHSAGILSSIYRGKYKTTLDLTNGFWAHPITPESYWLTAFTWQGKQYCWTRLPQGFLNSPALFTADVVDLLKEIPNVQAYVDDIYISHDDPQEHLEQLEKIFSILLNAGYVVSLKKSEIAQREVEFLGFNITKEGRGLTDTFKQKLLNITPPKDLKQLQSILGLLNFARNFIPNYSELVKPLYTIVANANGKFISWTEDNSNQLQHIISVLNQADNLEERNPETRLIIKVNSSPSAGYIRYYNEGSKRPIMYVNYIFSKAEAKFTQTEKLLTTMHKGLIKAMDLAMGQEILVYSPIVSMTKIQRTPLPERKALPVRWITWMTYLEDPRIQFHYDKSLPELQQIPNVTEDVIAKTKHPSEFAMVFYTDGSAIKHPDVNKSHSAGMGIAQVQFIPEYKIVHQWSIPLGDHTAQLAEIAAVEFACKKALKISGPVLIVTDSFYVAESANKELPYWKSNGFLNNKKKPLRHVSKWKSIAECLQLKPDIIIMHEKGHQQPMTTLHTEGNNLADKLATQGSYVVH

SEQ ID NO: 3230 - protein, 662 aa, synthetic construct
  source 1..662: note = Description of Artificial Sequence: Synthetic polypeptide
VPWLMKKPLQLTVLVPLHEYQERLLQQTALPKEQKELLQKLFLKYDALWQHWENQVGHRRIKPHNIATGTLAPRPQKQYPINPKAKPSIQIVIDDLLKQGVLIQQNSTMNTPVYPVPKPDGKWRMVLDYREVNKTIPLIAAQNQHSAGILSSIYRGKYKTTLDLTNGFWAHPITPESYWLTAFTWQGKQYCWTRLPQGFLNSPALFNADVVDLLKEIPNVQAYVDDIYISHDDPQEHLEQLEKIFSILLNAGYVVSLKKSEIAQREVEFLGFNITKEGRGLTDTFKQKLLNITPPKDLKQLQSILGLLNFARNFIPNYSELVKPLYTIVAPANGKFISWTEDNSNQLQHIISVLNQADNLEERNPETRLIIKVNSSPSAGYIRYYNEGSKRPIMYVNYIFSKAEAKFTQTEKLLTTMHKGLIKAMDLAMGQEILVYSPIVSMTKIQRTPLPERKALPVRWITWMTYLEDPRIQFHYDKSLPELQQIPNVTEDVIAKTKHPSEFAMVFYTDGSAIKHPDVNKSHSAGMGIAQVQFIPEYKIVHQWSIPLGDHTAQLAEIAAVEFACKKALKISGPVLIVTDSFYVAESANKELPYWKSNGFLNNKKKPLRHVSKWKSIAECLQLKPDIIIMHEKGHQQPMTTLHTEGNNLADKLATQGSYVVH

SEQ ID NO: 3231 - protein, 662 aa, synthetic construct
  source 1..662: note = Description of Artificial Sequence: Synthetic polypeptide
VPWLMKKPLQLTVLVPLHEYQERLLQQTALPKEQKELLQKLFLKYDALWQHWENQVGHRRIKPHNIATGTLAPRPQKQYPINPKAKPSIQIVIDDLLKQGVLIQQNSTMNTPVYPVPKPDGKWRMVLDYREVNKTIPLIAAQNQHSAGILSSIYRGKYKTTLDLTNGFWAHPITPESYWLTAFTWQGKQYCWTRLPQGFLNSPALFNADVVDLLKEIPNVQAYVDDIYISHDDPQEHLEQLEKIFSILLNAGYVVSLKKSEIAQREVEFLGFNITKEGRGLTDTFKQKLLNITPPKDLKQLQSILGKLNFARNFIPNYSELVKPLYTIVAPANGKFISWTEDNSNQLQHIISVLNQADNLEERNPETRLIIKVNSSPSAGYIRYYNEGSKRPIMYVNYIFSKAEAKFTQTEKLLTTMHKGLIKAMDLAMGQEILVYSPIVSMTKIQRTPLPERKALPVRWITWMTYLEDPRIQFHYDKSLPELQQIPNVTEDVIAKTKHPSEFAMVFYTDGSAIKHPDVNKSHSAGMGIAQVQFIPEYKIVHQWSIPLGDHTAQLAEIAAVEFACKKALKISGPVLIVTDSFYVAESANKELPYWKSNGFLNNKKKPLRHVSKWKSIAECLQLKPDIIIMHEKGHQQPMTTLHTEGNNLADKLATQGSYVVH

SEQ ID NO: 3232 - protein, 751 aa, synthetic construct
  source 1..751: note = Description of Artificial Sequence: Synthetic polypeptide
MDPLQLLQPLEAEIKGTKLKAHWNSGATITCVPEAFLEDERPIQTMLIKTIHGEKQQDVYYLTFKVQGRKVEAEVLASPYDYILLNPSDVPWLMKKPLQLTVLVPLHEYQERLLQQTALPKEQKELLQKLFLKYDALWQHWENQVGHRRIKPHNIATGTLAPRPQKQYPINPKAKPSIQIVIDDLLKQGVLIQQNSTMNTPVYPVPKPDGKWRMVLDYREVNKTIPLIAAQNQHSAGILSSIYRGKYKTTLDLTNGFWAHPITPESYWLTAFTWQGKQYCWTRLPQGFLNSPALFNADVVDLLKEIPNVQAYVDDIYISHDDPQEHLEQLEKIFSILLNAGYVVSLKKSEIAQREVEFLGFNITKEGRGLTDTFKQKLLNITPPKDLKQLQSILGLLNFARNFIPNYSELVKPLYTIVAPANGKFISWTEDNSNQLQHIISVLNQADNLEERNPETRLIIKVNSSPSAGYIRYYNEGSKRPIMYVNYIFSKAEAKFTQTEKLLTTMHKGLIKAMDLAMGQEILVYSPIVSMTKIQRTPLPERKALPVRWITWMTYLEDPRIQFHYDKSLPELQQIPNVTEDVIAKTKHPSEFAMVFYTDGSAIKHPDVNKSHSAGMGIAQVQFIPEYKIVHQWSIPLGDHTAQLAEIAAVEFACKKALKISGPVLIVTDSFYVAESANKELPYWKSNGFLNNKKKPLRHVSKWKSIAECLQLKPDIIIMHEKGHQQPMTTLHTEGNNLADKLATQGSYVVH

SEQ ID NO: 3233 - protein, 751 aa, synthetic construct
  source 1..751: note = Description of Artificial Sequence: Synthetic polypeptide
MDPLQLLQPLEAEIKGTKLKAHWNSGATITCVPEAFLEDERPIQTMLIKTIHGEKQQDVYYLTFKVQGRKVEAEVLASPYDYILLNPSDVPWLMKKPLQLTVLVPLHEYQERLLQQTALPKEQKELLQKLFLKYDALWQHWENQVGHRRIKPHNIATGTLAPRPQKQYPINPKAKPSIQIVIDDLLKQGVLIQQNSTMNTPVYPVPKPDGKWRMVLDYREVNKTIPLIAAQNQHSAGILSSIYRGKYKTTLDLTNGFWAHPITPESYWLTAFTWQGKQYCWTRLPQGFLNSPALFNADVVDLLKEIPNVQAYVDDIYISHDDPQEHLEQLEKIFSILLNAGYVVSLKKSEIAQREVEFLGFNITKEGRGLTDTFKQKLLNITPPKDLKQLQSILGKLNFARNFIPNYSELVKPLYTIVAPANGKFISWTEDNSNQLQHIISVLNQADNLEERNPETRLIIKVNSSPSAGYIRYYNEGSKRPIMYVNYIFSKAEAKFTQTEKLLTTMHKGLIKAMDLAMGQEILVYSPIVSMTKIQRTPLPERKALPVRWITWMTYLEDPRIQFHYDKSLPELQQIPNVTEDVIAKTKHPSEFAMVFYTDGSAIKHPDVNKSHSAGMGIAQVQFIPEYKIVHQWSIPLGDHTAQLAEIAAVEFACKKALKISGPVLIVTDSFYVAESANKELPYWKSNGFLNNKKKPLRHVSKWKSIAECLQLKPDIIIMHEKGHQQPMTTLHTEGNNLADKLATQGSYVVH

SEQ ID NO: 3234 - protein, 751 aa, synthetic construct
  source 1..751: note = Description of Artificial Sequence: Synthetic polypeptide
MDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFTADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATANGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVN

SEQ ID NO: 3235 - protein, 662 aa, synthetic construct
  source 1..662: note = Description of Artificial Sequence: Synthetic polypeptide
IPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFTADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATANGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVN

SEQ ID NO: 3236 - protein, 662 aa, synthetic construct
  source 1..662: note = Description of Artificial Sequence: Synthetic polypeptide
IPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVN

SEQ ID NO: 3237 - protein, 662 aa, synthetic construct
  source 1..662: note = Description of Artificial Sequence: Synthetic polypeptide
IPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGKLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVN

SEQ ID NO: 3238 - protein, 751 aa, synthetic construct
  source 1..751: note = Description of Artificial Sequence: Synthetic polypeptide
MDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVN

SEQ ID NO: 3239 - protein, 751 aa, synthetic construct
  source 1..751: note = Description of Artificial Sequence: Synthetic polypeptide
MDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGKLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVN

SEQ ID NO: 3240 - protein, 751 aa, synthetic construct
  source 1..751: note = Description of Artificial Sequence: Synthetic polypeptide
MNPLQLLQPLPAEVKGTKLLAHWNSGATITCIPESFLEDEQPIKQTLIKTIHGEKQQNVYYLTFKVKGRKVEAEVIASPYEYILLSPTDVPWLTQQPLQLTILVPLQEYQDRILNKTALPEEQKQQLKALFTKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPDSYWLTAFTWQGKQYCWTRLPQGFLNSPALFTADAVDLLKEVPNVQVYVDDIYLSHDNPHEHIQQLEKVFQILLQAGYVVSLKKSEIGQRTVEFLGFNITKEGRGLTDTFKTKLLNVTPPKDLKQLQSILGLLNFARNFIPNFAELVQTLYNLIASSKGKYIEWTEDNTKQLNKVIEALNTASNLEERLPDQRLVIKVNTSPSAGYVRYYNESGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSIPPLKHPSQYEGVFCTDGSAIKSPDPTKSNNAGMGIVHAIYNPEYKILNQWSIPLGHHTAQMAEIAAVEFACKKALKVPGPVLVITDSFYVAESANKELPYWKSNGFVNNKKEPLKHISKWKSIAECLSIKPDITIQHEKGHQPINTSIHTEGNALADKLATQGSYVVN

SEQ ID NO: 3241 - protein, 662 aa, synthetic construct
  source 1..662: note = Description of Artificial Sequence: Synthetic polypeptide
VPWLTQQPLQLTILVPLQEYQDRILNKTALPEEQKQQLKALFTKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPDSYWLTAFTWQGKQYCWTRLPQGFLNSPALFTADAVDLLKEVPNVQVYVDDIYLSHDNPHEHIQQLEKVFQILLQAGYVVSLKKSEIGQRTVEFLGFNITKEGRGLTDTFKTKLLNVTPPKDLKQLQSILGLLNFARNFIPNFAELVQTLYNLIASSKGKYIEWTEDNTKQLNKVIEALNTASNLEERLPDQRLVIKVNTSPSAGYVRYYNESGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSIPPLKHPSQYEGVFCTDGSAIKSPDPTKSNNAGMGIVHAIYNPEYKILNQWSIPLGHHTAQMAEIAAVEFACKKALKVPGPVLVITDSFYVAESANKELPYWKSNGFVNNKKEPLKHISKWKSIAECLSIKPDITIQHEKGHQPINTSIHTEGNALADKLATQGSYVVN

SEQ ID NO: 3242 - protein, 662 aa, synthetic construct
  source 1..662: note = Description of Artificial Sequence: Synthetic polypeptide
VPWLTQQPLQLTILVPLQEYQDRILNKTALPEEQKQQLKALFTKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPDSYWLTAFTWQGKQYCWTRLPQGFLNSPALFNADAVDLLKEVPNVQVYVDDIYLSHDNPHEHIQQLEKVFQILLQAGYVVSLKKSEIGQRTVEFLGFNITKEGRGLTDTFKTKLLNVTPPKDLKQLQSILGLLNFARNFIPNFAELVQTLYNLIASSPGKYIEWTEDNTKQLNKVIEALNTASNLEERLPDQRLVIKVNTSPSAGYVRYYNESGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSIPPLKHPSQYEGVFCTDGSAIKSPDPTKSNNAGMGIVHAIYNPEYKILNQWSIPLGHHTAQMAEIAAVEFACKKALKVPGPVLVITDSFYVAESANKELPYWKSNGFVNNKKEPLKHISKWKSIAECLSIKPDITIQHEKGHQPINTSIHTEGNALADKLATQGSYVVN

SEQ ID NO: 3243 - protein, 662 aa, synthetic construct
  source 1..662: note = Description of Artificial Sequence: Synthetic polypeptide
VPWLTQQPLQLTILVPLQEYQDRILNKTALPEEQKQQLKALFTKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPDSYWLTAFTWQGKQYCWTRLPQGFLNSPALFNADAVDLLKEVPNVQVYVDDIYLSHDNPHEHIQQLEKVFQILLQAGYVVSLKKSEIGQRTVEFLGFNITKEGRGLTDTFKTKLLNVTPPKDLKQLQSILGKLNFARNFIPNFAELVQTLYNLIASSPGKYIEWTEDNTKQLNKVIEALNTASNLEERLPDQRLVIKVNTSPSAGYVRYYNESGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSIPPLKHPSQYEGVFCTDGSAIKSPDPTKSNNAGMGIVHAIYNPEYKILNQWSIPLGHHTAQMAEIAAVEFACKKALKVPGPVLVITDSFYVAESANKELPYWKSNGFVNNKKEPLKHISKWKSIAECLSIKPDITIQHEKGHQPINTSIHTEGNALADKLATQGSYVVN

SEQ ID NO: 3244 - protein, 751 aa, synthetic construct
  source 1..751: note = Description of Artificial Sequence: Synthetic polypeptide
MNPLQLLQPLPAEVKGTKLLAHWNSGATITCIPESFLEDEQPIKQTLIKTIHGEKQQNVYYLTFKVKGRKVEAEVIASPYEYILLSPTDVPWLTQQPLQLTILVPLQEYQDRILNKTALPEEQKQQLKALFTKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPDSYWLTAFTWQGKQYCWTRLPQGFLNSPALFNADAVDLLKEVPNVQVYVDDIYLSHDNPHEHIQQLEKVFQILLQAGYVVSLKKSEIGQRTVEFLGFNITKEGRGLTDTFKTKLLNVTPPKDLKQLQSILGLLNFARNFIPNFAELVQTLYNLIASSPGKYIEWTEDNTKQLNKVIEALNTASNLEERLPDQRLVIKVNTSPSAGYVRYYNESGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSIPPLKHPSQYEGVFCTDGSAIKSPDPTKSNNAGMGIVHAIYNPEYKILNQWSIPLGHHTAQMAEIAAVEFACKKALKVPGPVLVITDSFYVAESANKELPYWKSNGFVNNKKEPLKHISKWKSIAECLSIKPDITIQHEKGHQPINTSIHTEGNALADKLATQGSYVVN

SEQ ID NO: 3245 - protein, 751 aa, synthetic construct
  source 1..751: note = Description of Artificial Sequence: Synthetic polypeptide
MNPLQLLQPLPAEVKGTKLLAHWNSGATITCIPESFLEDEQPIKQTLIKTIHGEKQQNVYYLTFKVKGRKVEAEVIASPYEYILLSPTDVPWLTQQPLQLTILVPLQEYQDRILNKTALPEEQKQQLKALFTKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPDSYWLTAFTWQGKQYCWTRLPQGFLNSPALFNADAVDLLKEVPNVQVYVDDIYLSHDNPHEHIQQLEKVFQILLQAGYVVSLKKSEIGQRTVEFLGFNITKEGRGLTDTFKTKLLNVTPPKDLKQLQSILGKLNFARNFIPNFAELVQTLYNLIASSPGKYIEWTEDNTKQLNKVIEALNTASNLEERLPDQRLVIKVNTSPSAGYVRYYNESGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSIPPLKHPSQYEGVFCTDGSAIKSPDPTKSNNAGMGIVHAIYNPEYKILNQWSIPLGHHTAQMAEIAAVEFACKKALKVPGPVLVITDSFYVAESANKELPYWKSNGFVNNKKEPLKHISKWKSIAECLSIKPDITIQHEKGHQPINTSIHTEGNALADKLATQGSYVVN

SEQ ID NO: 3246 - protein, 592 aa, synthetic construct
  source 1..592: note = Description of Artificial Sequence: Synthetic polypeptide
PRSRAIDIPVPHADKISWKITDPVWVDQWPLTYEKTLAAIALVQEQLAAGHIEPTNSPWNTPIFIIKKKSGSWRLLQDLRAVNKVMVPMGALQPGLPSPVAIPLNYHKIVIDLKDCFFTIPLHPEDRPYFAFSVPQINFQSPMPRYQWKVLPQGMANSPTLCQKFVAAAIAPVRSQWPEAYILHYMDDILLACDSAEAAKACYAHIISCLTSYGLKIAPDKVQVSEPFSYLGFELHHQQVFTPRVCLKTDHLKTLNDFQKLLGDIQWLRPYLKLPTSALVPLNNILKGDPNPLSVRALTPEAKQSLALINKAIQNQSVQQISYNLPLVLLLLPTPHTPTAVFWQPNGTDPTKNGSPLLWLHLPASPSKVLLTYPSLLAMLIIKGRYTGRQLFGRDPHSIIIPYTQDQLTWLLQTSDEWAIALSSFTGDIDNHYPSDPVIQFAKLHQFIFPKITKCAPIPQATLVFTDGSSNGIAAYVIDNQPISIKSPYLSAQLVELYAILQVFTVLAHQPFNLYTDSAYIAQSVPLLETVPFIKSSTNATPLFSKLQQLILNRQHPFFIGHLRAHLNLPGPLAEGNALADAATQIFPIISD

SEQ ID NO: 3247 - protein, 592 aa, synthetic construct
  source 1..592: note = Description of Artificial Sequence: Synthetic polypeptide
PRSRAIDIPVPHADKISWKITDPVWVDQWPLTYEKTLAAIALVQEQLAAGHIEPTNSPWNTPIFIIKKKSGSWRLLQDLRAVNKVMVPMGALQPGLPSPVAIPLNYHKIVIDLKDCFFTIPLHPEDRPYFAFSVPQINFQSPMPRYQWKVLPQGMANSPTLCQKFVAAAIAPVRSQWPEAYILHYMDDILLACDSAEAAKACYAHIISCLTSYGLKIAPDKVQVSEPFSYLGFELHHQQVFTPRVCLKTDHLKTLNDFQKLLGDIQWLRPYLKLPTSALVPLNNILKPDPNPLSVRALTPEAKQSLALINKAIQNQSVQQISYNLPLVLLLLPTPHTPTAVFWQPNGTDPTKNGSPLLWLHLPASPSKVLLTYPSLLAMLIIKGRYTGRQLFGRDPHSIIIPYTQDQLTWLLQTSDEWAIALSSFTGDIDNHYPSDPVIQFAKLHQFIFPKITKCAPIPQATLVFTDGSSNGIAAYVIDNQPISIKSPYLSAQLVELYAILQVFTVLAHQPFNLYTDSAYIAQSVPLLETVPFIKSSTNATPLFSKLQQLILNRQHPFFIGHLRAHLNLPGPLAEGNALADAATQIFPIISD

SEQ ID NO: 3248 - protein, 592 aa, synthetic construct
  source 1..592: note = Description of Artificial Sequence: Synthetic polypeptide
PRSRAIDIPVPHADKISWKITDPVWVDQWPLTYEKTLAAIALVQEQLAAGHIEPTNSPWNTPIFIIKKKSGSWRLLQDLRAVNKVMVPMGALQPGLPSPVAPPLNYHKIVIDLKDCFFTIPLHPEDRPYFAFSVPQINFQSPMPRYQWKVLPQGMANSPTLCQKFVAAAIAPVRSQWPEAYILHYMDDILLACDSAEAAKACYAHIISCLTSYGLKIAPDKVQVSEPFSYLGFELHHQQVFTPRVCLKTDHLKTLNDFQKLLGDIQWLRPYLKLPTSALVPLNNILKPDPNPLSVRALTPEAKQSLALINKAIQNQSVQQISYNLPLVLLLLPTPHTPTAVFWQPNGTDPTKNGSPLLWLHLPASPSKVLLTYPSLLAMLIIKGRYTGRQLFGRDPHSIIIPYTQDQLTWLLQTSDEWAIALSSFTGDIDNHYPSDPVIQFAKLHQFIFPKITKCAPIPQATLVFTDGSSNGIAAYVIDNQPISIKSPYLSAQLVELYAILQVFTVLAHQPFNLYTDSAYIAQSVPLLETVPFIKSSTNATPLFSKLQQLILNRQHPFFIGHLRAHLNLPGPLAEGNALADAATQIFPIISD

SEQ ID NO: 3249 - protein, 585 aa, synthetic construct
  source 1..585: note = Description of Artificial Sequence: Synthetic polypeptide
LTAAIDMLAPQQCAEPITWKSDEPVWVDQWPLTSEKLAAAQQLVQEQLEAGHITESNSPWNTPIFVIKKKSGKWRLLQDLRAVNATMVLMGALQPGLPSPVAIPQGYLKIIIDLKDCFFSIPLHPSDQKRFAFSLPSTNFKEPMQRFQWKVLPQRMANSPTLCQKYVATAIHKVRHAWKQMYIIHYMDDILIAGKDGQQVLQCFDQLKQELTIAGLHIAPEKIQLQDPYTYLGFELNGPKITNQKAVIRKDKLQTLNDFQKLLGDINWLRPYLKLTTADLKPLFDTLKGDSNPNSHRSLSKEALALLDKVETAIAEQFVTHINYSLPLMFLIFNTALTPTGLFWQNNPIMWVHLPASPKKVLLPYYDAIADLIILGRDHSKKYFGIEPSVIIQPYSKSQIDWLMQNTEMWPIACASYVGILDNHYPPNKLIQFCKLHAFIFPQIISKTPLNNALLVFTDGSSTGMAAYTLADTTIKFQTNLNSAQLVELQALIAVLSAFPNQPLNIYTDSAYLAHSIPLLETVAQIKHISETAKLFLQCQQLIYNRSIPFYIGHVRAHSGLPGPIAHGNQKADLATKTVASNINT

SEQ ID NO: 3250 - protein, 585 aa, synthetic construct
  source 1..585: note = Description of Artificial Sequence: Synthetic polypeptide
LTAAIDMLAPQQCAEPITWKSDEPVWVDQWPLTSEKLAAAQQLVQEQLEAGHITESNSPWNTPIFVIKKKSGKWRLLQDLRAVNATMVLMGALQPGLPSPVAPPQGYLKIIIDLKDCFFSIPLHPSDQKRFAFSLPSTNFKEPMQRFQWKVLPQRMANSPTLCQKYVATAIHKVRHAWKQMYIIHYMDDILIAGKDGQQVLQCFDQLKQELTIAGLHIAPEKIQLQDPYTYLGFELNGPKITNQKAVIRKDKLQTLNDFQKLLGDINWLRPYLKLTTADLKPLFDTLKGDSNPNSHRSLSKEALALLDKVETAIAEQFVTHINYSLPLMFLIFNTALTPTGLFWQNNPIMWVHLPASPKKVLLPYYDAIADLIILGRDHSKKYFGIEPSVIIQPYSKSQIDWLMQNTEMWPIACASYVGILDNHYPPNKLIQFCKLHAFIFPQIISKTPLNNALLVFTDGSSTGMAAYTLADTTIKFQTNLNSAQLVELQALIAVLSAFPNQPLNIYTDSAYLAHSIPLLETVAQIKHISETAKLFLQCQQLIYNRSIPFYIGHVRAHSGLPGPIAHGNQKADLATKTVASNINT

SEQ ID NO: 3251 - protein, 585 aa, synthetic construct
  source 1..585: note = Description of Artificial Sequence: Synthetic polypeptide
LATAVDILAPQRYADPITWKSDEPVWVDQWPLTQEKLAAAQQLVQEQLQAGHIIESNSPWNTPIFVIKKKSGKWRLLQDLRAVNATMVLMGALQPGLPSPVAIPQGYFKIVIDLKDCFFTIPLQPVDQKRFAFSLPSTNFKQPMKRYQWKVLPQGMANSPTLCQKYVAAAIEPVRKSWAQMYIIHYMDDILIAGKLGEQVLQCFAQLKQALTTTGLQIAPEKVQLQDPYTYLGFQINGPKITNQKAVIRRDKLQTLNDFQKLLGDINWLRPYLHLTTGDLKPLFDILKGDSNPNSPRSLSEAALASLQKVETAIAEQFVTQIDYTQPLTFLIFNTTLTPTGLFWQNNPVMWVHLPASPKKVLLPYYDAIADLIILGRDNSKKYFGLEPSTIIQPYSKSQIHWLMQNTETWPIACASYAGNIDNHYPPNKLIQFCKLHAVVFPRIISKTPLDNALLVFTDGSSTGIAAYTFEKTTVRFKTSHTSAQLVELQALIAVLSAFPHRALNVYTDSAYLAHSIPLLETVSHIKHISDTAKFFLQCQQLIYNRSIPFYLGHIRAHSGLPGPLSQGNHITDLATKVVATTLTT

SEQ ID NO: 3252 - protein, 585 aa, synthetic construct
  source 1..585: note = Description of Artificial Sequence: Synthetic polypeptide
LATAVDILAPQRYADPITWKSDEPVWVDQWPLTQEKLAAAQQLVQEQLQAGHIIESNSPWNTPIFVIKKKSGKWRLLQDLRAVNATMVLMGALQPGLPSPVAPPQGYFKIVIDLKDCFFTIPLQPVDQKRFAFSLPSTNFKQPMKRYQWKVLPQGMANSPTLCQKYVAAAIEPVRKSWAQMYIIHYMDDILIAGKLGEQVLQCFAQLKQALTTTGLQIAPEKVQLQDPYTYLGFQINGPKITNQKAVIRRDKLQTLNDFQKLLGDINWLRPYLHLTTGDLKPLFDILKGDSNPNSPRSLSEAALASLQKVETAIAEQFVTQIDYTQPLTFLIFNTTLTPTGLFWQNNPVMWVHLPASPKKVLLPYYDAIADLIILGRDNSKKYFGLEPSTIIQPYSKSQIHWLMQNTETWPIACASYAGNIDNHYPPNKLIQFCKLHAVVFPRIISKTPLDNALLVFTDGSSTGIAAYTFEKTTVRFKTSHTSAQLVELQALIAVLSAFPHRALNVYTDSAYLAHSIPLLETVSHIKHISDTAKFFLQCQQLIYNRSIPFYLGHIRAHSGLPGPLSQGNHITDLATKVVATTLTT

SEQ ID NO: 3253 - protein, 650 aa, synthetic construct
  source 1..650: note = Description of Artificial Sequence: Synthetic polypeptide
SCQTKNTLNIDEYLLQFPDQLWASLPTDIGRMLVPPITIKIKDNASLPSIRQYPLPKDKTEGLRPLISSLENQGILIKCHSPCNTPIFPIKKAGRDEYRMIHDLRAINNIVAPLTAVVASPTTVLSNLAPSLHWFTVIDLSNAFFSVPIHKDSQYLFAFTFEGHQYTWTVLPQGFIHSPTLFSQALYQSLHKIKFKISSEICIYMDDVLIASKDRDTNLKDTAVMLQHLASEGHKVSKKKLQLCQQEVVYLGQLLTPEGRKILPDRKVTVSQFQQPTTIRQIRAFLGLVGYCRHWIPEFSIHSKFLEKQLKKDTAEPFQLDDQQVEAFNKLKHAITTAPVLVVPDPAKPFQLYTSHSEHASIAVLTQKHAGRTRPIAFLSSKFDAIESGLPPCLKACASIHRSLTQADSFILGAPLIIYTTHAICTLLQRDRSQLVTASRFSKWEADLLRPELTFVACSAVSPAHLYMQSCENNIPPHDCVLLTHTISRPRPDLSDLPIPDPDMTLFSDGSYTTGRGGAAVVMHRPVTDDFIIIHQQPGGASAQTAELLALAAACHLATDKTVNIYTDSRYAYGVVHDFGHLWMHRGFVTSAGTPIKNHKEIEYLLKQIMKPKQVSVIKIEAHTKGVSMEVRGNAAADEAAKNAVFLVQR

SEQ ID NO: 3254 - protein, 650 aa, synthetic construct
  source 1..650: note = Description of Artificial Sequence: Synthetic polypeptide
SCQTKNTLNIDEYLLQFPDQLWASLPTDIGRMLVPPITIKIKDNASLPSIRQYPLPKDKTEGLRPLISSLENQGILIKCHSPCNTPIFPIKKAGRDEYRMIHDLRAINNIVAPLTAVVASPTTVLSNLAPSLHWFTVIDLSNAFFSVPIHKDSQYLFAFTFEGHQYTWTVLPQGFIHSPTLFNQALYQSLHKIKFKISSEICIYMDDVLIASKDRDTNLKDTAVMLQHLASEGHKVSKKKLQLCQQEVVYLGQLLTPEGRKILPDRKVTVSQFQQPTTIRQIRAFLGLVGYCRHWIPEFSIHSKFLEKQLKPDTAEPFQLDDQQVEAFNKLKHAITTAPVLVVPDPAKPFQLYTSHSEHASIAVLTQKHAGRTRPIAFLSSKFDAIESGLPPCLKACASIHRSLTQADSFILGAPLIIYTTHAICTLLQRDRSQLVTASRFSKWEADLLRPELTFVACSAVSPAHLYMQSCENNIPPHDCVLLTHTISRPRPDLSDLPIPDPDMTLFSDGSYTTGRGGAAVVMHRPVTDDFIIIHQQPGGASAQTAELLALAAACHLATDKTVNIYTDSRYAYGVVHDFGHLWMHRGFVTSAGTPIKNHKEIEYLLKQIMKPKQVSVIKIEAHTKGVSMEVRGNAAADEAAKNAVFLVQR

SEQ ID NO: 3255 - protein, 650 aa, synthetic construct
  source 1..650: note = Description of Artificial Sequence: Synthetic polypeptide
SCQTKNTLNIDEYLLQFPDQLWASLPTDIGRMLVPPITIKIKDNASLPSIRQYPLPKDKTEGLRPLISSLENQGILIKCHSPCNTPIFPIKKAGRDEYRMIHDLRAINNIVAPLTAVVASPTTVLSNLAPSLHWFTVIDLSNAFFSVPIHKDSQYLFAFTFEGHQYTWTVLPQGFIHSPTLFNQALYQSLHKIKFKISSEICIYMDDVLIASKDRDTNLKDTAVMLQHLASEGHKVSKKKLQLCQQEVVYLGQLLTPEGRKILPDRKVTVSQFQQPTTIRQIRAFLGKVGYCRHFIPEFSIHSKFLEKQLKPDTAEPFQLDDQQVEAFNKLKHAITTAPVLVVPDPAKPFQLYTSHSEHASIAVLTQKHAGRTRPIAFLSSKFDAIESGLPPCLKACASIHRSLTQADSFILGAPLIIYTTHAICTLLQRDRSQLVTASRFSKWEADLLRPELTFVACSAVSPAHLYMQSCENNIPPHDCVLLTHTISRPRPDLSDLPIPDPDMTLFSDGSYTTGRGGAAVVMHRPVTDDFIIIHQQPGGASAQTAELLALAAACHLATDKTVNIYTDSRYAYGVVHDFGHLWMHRGFVTSAGTPIKNHKEIEYLLKQIMKPKQVSVIKIEAHTKGVSMEVRGNAAADEAAKNAVFLVQR

SEQ ID NO: 3256 - protein, 669 aa, synthetic construct
  source 1..669: note = Description of Artificial Sequence: Synthetic polypeptide
VLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFDEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGTAGFCRLWIPGFASLAAPLYPLTKESIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGLLTSAGKDIKNKEEILALLEAIHLPKRVAIIHCPGHQKGNDPVATGNRRADEAAKQAALSTRVLAETTKP

SEQ ID NO: 3257 - protein, 669 aa, synthetic construct
  source 1..669: note = Description of Artificial Sequence: Synthetic polypeptide
VLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGTAGFCRLWIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKP

SEQ ID NO: 3258 - protein, 669 aa, synthetic construct
  source 1..669: note = Description of Artificial Sequence: Synthetic polypeptide
VLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGKAGFCRLFIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKP

SEQ ID NO: 3259 - protein, 671 aa, synthetic construct
  source 1..671: note = Description of Artificial Sequence: Synthetic polypeptide
TLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFDEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGTAGFCRLWIPGFAEMAAPLYPLTKTGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGLLTSEGREIKNKNEILALLKALFLPKRLSIIHCPGHQKGNSAEARGNRMADQAAREAAMKAVLETSTLL

SEQ ID NO: 3260 - protein, 671 aa, synthetic construct
  source 1..671: note = Description of Artificial Sequence: Synthetic polypeptide
TLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGTAGFCRLWIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLL

SEQ ID NO: 3261 - protein, 671 aa, synthetic construct
  source 1..671: note = Description of Artificial Sequence: Synthetic polypeptide
TLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLL

SEQ ID NO: 3262 - protein, 1082 aa, synthetic construct
  source 1..1082: note = Description of Artificial Sequence: Synthetic polypeptide
MAAFKPNPINYILGLDIGIASVGWAMVEIDEEENPIRLIDLGVRVFERAEVPKTGDSLAMARRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVANNAHALQTGDFRTPAELALNKFEKESGHIRNQRGDYSHTFSRKDLQAELILLFEKQKEFGNPHVSGGLKEGIETLLMTQRPALSGDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSSELQDEIGTAFSLFKTDEDITGRLKDRVQPEILEALLKHISFDKFVQISLKALRRIVPLMEQGKRYDEACAEIYGDHYGKKNTEEKIYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLVRLNEKGYVEIDHALPFSRTWDDSFNNKVLVLGSENQNKGNQTPYEYFNGKDNSREWQEFKARVETSRFPRSKKQRILLQKFDEDGFKECNLNDTRYVNRFLCQFVADHILLTGKGKRRVFASNGQITNLLRGFWGLRKVRAENDRHHALDAVVVACSTVAMQQKITRFVRYKEMNAFDGKTIDKETGKVLHQKTHFPQPWEFFAQEVMIRVFGKPDGKPEFEEADTPEKLRTLLAEKLSSRPEAVHEYVTPLFVSRAPNRKMSGAHKDTLRSAKRFVKHNEKISVKRVWLTEIKLADLENMVNYKNGREIELYEALKARLEAYGGNAKQAFDPKDNPFYKKGGQLVKAVRVEKTQESGVLLNKKNAYTIADNGDMVRVDVFCKVDKKGKNQYFIVPIYAWQVAENILPDIDCKGYRIDDSYTFCFSLHKYDLIAFQKDEKSKVEFAYYINCDSSNGRFYLAWHDKGSKEQQFRISTQNLVLIQKYQVNELGKEIRPCRLKKRPPVR

SEQ ID NO: 3263 - protein, 1055 aa, synthetic construct
  source 1..1055: note = Description of Artificial Sequence: Synthetic polypeptide
MQNNPLNYILGLDLGIASIGWAVVEIDEESSPIRLIDVGVRTFERAEVAKTGESLALSRRLARSSRRLIKRRAERLKKAKRLLKAEKILHSIDEKLPINVWQLRVKGLKEKLERQEWAAVLLHLSKHRGYLSQRKNEGKSDNKELGALLSGIASNHQMLQSSEYRTPAEIAVKKFQVEEGHIRNQRGSYTHTFSRLDLLAEMELLFQRQAELGNSYTSTTLLENLTALLMWQKPALAGDAILKMLGKCTFEPSEYKAAKNSYSAERFVWLTKLNNLRILENGTERALNDNERFALLEQPYEKSKLTYAQVRAMLALSDNAIFKGVRYLGEDKKTVESKTTLIEMKFYHQIRKTLGSAELKKEWNELKGNSDLLDEIGTAFSLYKTDDDICRYLEGKLPERVLNALLENLNFDKFIQLSLKALHQILPLMLQGQRYDEAVSAIYGDHYGKKSTETTRLLPTIPADEIRNPVVLRTLTQARKVINAVVRLYGSPARIHIETAREVGKSYQDRKKLEKQQEDNRKQRESAVKKFKEMFPHFVGEPKGKDILKMRLYELQQAKCLYSGKSLELHRLLEKGYVEVDHALPFSRTWDDSFNNKVLVLANENQNKGNLTPYEWLDGKNNSERWQHFVVRVQTSGFSYAKKQRILNHKLDEKGFIERNLNDTRYVARFLCNFIADNMLLVGKGKRNVFASNGQITALLRHRWGLQKVREQNDRHHALDAVVVACSTVAMQQKITRFVRYNEGNVFSGERIDRETGEIIPLHFPSPWAFFKENVEIRIFSENPKLELENRLPDYPQYNHEWVQPLFVSRMPTRKMTGQGHMETVKSAKRLNEGLSVLKVPLTQLKLSDLERMVNRDREIALYESLKARLEQFGNDPAKAFAEPFYKKGGALVKAVRLEQTQKSGVLVRDGNGVADNASMVRVDVFTKGGKYFLVPIYTWQVAKGILPNRAATQGKDENDWDIMDEMATFQFSLCQNDLIKLVTKKKTIFGYFNGLNRATSNINIKEHDLDKSKGKLGIYLEVGVKLAISLEKYQVDELGKNIRPCRPTKRQHVR

SEQ ID NO: 3264 - protein, 1053 aa, synthetic construct
  source 1..1053: note = Description of Artificial Sequence: Synthetic polypeptide
MKRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEENSKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPRIIKTIASKTQSIKKYSTDILGNLYEVKSKKHPQIIKKG

SEQ ID NO: 3265 - protein, 1053 aa, synthetic construct
  source 1..1053: note = Description of Artificial Sequence: Synthetic polypeptide
MKRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEENSKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRKLINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYKNDLIKINGELYRVIGVNNDLLNRIEVNMIDITYREYLENMNDKRPPHIIKTIASKTQSIKKYSTDILGNLYEVKSKKHPQIIKKG

SEQ ID NO: 3266 - protein, 1061 aa, synthetic construct
  source 1..1061: note = Description of Artificial Sequence: Synthetic polypeptide
MQENQQKQNYILGLDIGITSVGYGLIDSKTREVIDAGVRLFPEADSENNSNRRSKRGARRLKRRRIHRLNRVKDLLADYQMIDLNNVPKSTDPYTIRVKGLREPLTKEEFAIALLHIAKRRGLHNISVSMGDEEQDNELSTKQQLQKNAQQLQDKYVCELQLERLTNINKVRGEKNRFKTEDFVKEVKQLCETQRQYHNIDDQFIQQYIDLVSTRREYFEGPGNGSPYGWDGDLLKWYEKLMGRCTYFPEELRSVKYAYSADLFNALNDLNNLVVTRDDNPKLEYYEKYHIIENVFKQKKNPTLKQIAKEIGVQDYDIRGYRITKSGKPQFTSFKLYHDLKNIFEQAKYLEDVEMLDEIAKILTIYQDEISIKKALDQLPELLTESEKSQIAQLTGYTGTHRLSLKCIHIVIDELWESPENQMEIFTRLNLKPKKVEMSEIDSIPTTLVDEFILSPVVKRAFIQSIKVINAVINRFGLPEDIIIELAREKNSKDRRKFINKLQKQNEATRKKIEQLLAKYGNTNAKYMIEKIKLHDMQEGKCLYSLEAIPLEDLLSNPTHYEVDHIIPRSVSFDNSLNNKVLVKQSENSKKGNRTPYQYLSSNESKISYNQFKQHILNLSKAKDRISKKKRDMLLEERDINKFEVQKEFINRNLVDTRYATRELSNLLKTYFSTHDYAVKVKTINGGFTNHLRKVWDFKKHRNHGYKHHAEDALVIANADFLFKTHKALRRTDKILEQPGLEVNDTTVKVDTEEKYQELFETPKQVKNIKQFRDFKYSHRVDKKPNRQLINDTLYSTREIDGETYVVQTLKDLYAKDNEKVKKLFTERPQKILMYQHDPKTFEKLMTILNQYAEAKNPLAAYYEDKGEYVTKYAKKGNGPAIHKIKYIDKKLGSYLDVSNKYPETQNKLVKLSLKSFRFDIYKCEQGYKMVSIGYLDVLKKDNYYYIPKDKYEAEKQKKKIKESDLFVGSFYYNDLIMYEDELFRVIGVNSDINNLVELNMVDITYKDFCEVNNVTGEKRIKKTIGKRVVLIEKYTTDILGNLYKTPLPKKPQLIFKRGEL

SEQ ID NO: 3267 - protein, 1061 aa, synthetic construct
  source 1..1061: note = Description of Artificial Sequence: Synthetic polypeptide
MQENQQKQNYILGLDIGITSVGYGLIDSKTREVIDAGVRLFPEADSENNSNRRSKRGARRLKRRRIHRLNRVKDLLADYQMIDLNNVPKSTDPYTIRVKGLREPLTKEEFAIALLHIAKRRGLHNISVSMGDEEQDNELSTKQQLQKNAQQLQDKYVCELQLERLTNINKVRGEKNRFKTEDFVKEVKQLCETQRQYHNIDDQFIQQYIDLVSTRREYFEGPGNGSPYGWDGDLLKWYEKLMGRCTYFPEELRSVKYAYSADLFNALNDLNNLVVTRDDNPKLEYYEKYHIIENVFKQKKNPTLKQIAKEIGVQDYDIRGYRITKSGKPQFTSFKLYHDLKNIFEQAKYLEDVEMLDEIAKILTIYQDEISIKKALDQLPELLTESEKSQIAQLTGYTGTHRLSLKCIHIVIDELWESPENQMEIFTRLNLKPKKVEMSEIDSIPTTLVDEFILSPVVKRAFIQSIKVINAVINRFGLPEDIIIELAREKNSKDRRKFINKLQKQNEATRKKIEQLLAKYGNTNAKYMIEKIKLHDMQEGKCLYSLEAIPLEDLLSNPTHYEVDHIIPRSVSFDNSLNNKVLVKQSENSKKGNRTPYQYLSSNESKISYNQFKQHILNLSKAKDRISKKKRDMLLEERDINKFEVQKEFINRNLVDTRYATRELSNLLKTYFSTHDYAVKVKTINGGFTNHLRKVWDFKKHRNHGYKHHAEDALVIANADFLFKTHKALRRTDKILEQPGLEVNDTTVKVDTEEKYQELFETPKQVKNIKQFRDFKYSHRVDKKPNRKLINDTLYSTREIDGETYVVQTLKDLYAKDNEKVKKLFTERPQKILMYQHDPKTFEKLMTILNQYAEAKNPLAAYYEDKGEYVTKYAKKGNGPAIHKIKYIDKKLGSYLDVSNKYPETQNKLVKLSLKSFRFDIYKCEQGYKMVSIGYLDVLKKDNYYYIPKDKYEAEKQKKKIKESDLFVGSFYKNDLIMYEDELFRVIGVNSDINNLVELNMVDITYKDFCEVNNVTGEKHIKKTIGKRVVLIEKYTTDILGNLYKTPLPKKPQLIFKRGEL

SEQ ID NO: 3268 - protein, 1375 aa, synthetic construct
  source 1..1375: note = Description of Artificial Sequence: Synthetic polypeptide
MEKKYSIGLDIGTNSVGWAVITDDYKVPSKKFKVLGNTNRKSIKKNLMGALLFDSGETAEATRLKRTARRRYTRRKNRIRYLQEIFANEMAKLDDSFFQRLEESFLVEEDKKNERHPIFGNLADEVAYHRNYPTIYHLRKKLADSPEKADLRLIYLALAHIIKFRGHFLIEGKLNAENSDVAKLFYQLIQTYNQLFEESPLDEIEVDAKGILSARLSKSKRLEKLIAVFPNEKKNGLFGNIIALALGLTPNFKSNFDLTEDAKLQLSKDTYDDDLDELLGQIGDQYADLFSAAKNLSDAILLSDILRSNSEVTKAPLSASMVKRYDEHHQDLALLKTLVRQQFPEKYAEIFKDDTKNGYAGYVGADKKLRKRSGKLATEEEFYKFIKPILEKMDGAEELLAKLNRDDLLRKQRTFDNGSIPHQIHLKELHAILRRQEEFYPFLKENREKIEKILTFRIPYYVGPLARGNSRFAWLTRKSEEAITPWNFEEVVDKGASAQSFIERMTNFDEQLPNKKVLPKHSLLYEYFTVYNELTKVKYVTERMRKPEFLSGEQKKAIVDLLFKTNRKVTVKQLKEDYFKKIECFDSVEIIGVEDRFNASLGTYHDLLKIIKDKDFLDNEENEDILEDIVLTLTLFEDREMIEERLKTYAHLFDDKVMKQLKRRHYTGWGRLSRKMINGIRDKQSGKTILDFLKSDGFSNRNFMQLIHDDSLTFKEEIEKAQVSGQGDSLHEQIADLAGSPAIKKGILQTVKIVDELVKVMGHKPENIVIEMARENQTTTKGLQQSRERKKRIEEGIKELESQILKENPVENTQLQNEKLYLYYLQNGRDMYVDQELDINRLSDYDVDHIVPQSFIKDDSIDNKVLTRSVENRGKSDNVPSEEVVKKMKNYWRQLLNAKLITQRKFDNLTKAERGGLSEADKAGFIKRQLVETRQITKHVARILDSRMNTKRDKNDKPIREVKVITLKSKLVSDFRKDFQLYKVRDINNYHHAHDAYLNAVVGTALIKKYPKLESEFVYGDYKVYDVRKMIAKSEQEIGKATAKRFFYSNIMNFFKTEVKLANGEIRKRPLIETNGETGEVVWNKEKDFATVRKVLAMPQVNIVKKTEVQTGGFSKESILSKRESAKLIPRKKGWDTRKYGGFGSPTVAYSILVVAKVEKGKAKKLKSVKVLVGITIMEKGSYEKDPIGFLEAKGYKDIKKELIFKLPKYSLFELENGRRRMLASAKELQKANELVLPQHLVRLLYYTQNISATTGSNNLGYIEQHREEFKEIFEKIIDFSEKYILKNKVNSNLKSSFDEQFAVSDSILLSNSFVSLLKYTSFGASGGFTFLDLDVKQGRLRYQTVTEVLDATLIYQSITGLYETRTDLSQLGGD

SEQ ID NO: 3269 - protein, 1368 aa, synthetic construct [sequence omitted]

SEQ ID NO: 3270 - protein, 1368 aa, synthetic construct
  source 1..1368: note = Description of Artificial Sequence: Synthetic polypeptide
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESIRPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASARFLQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPRAFKYFDTTIDRKVYRSTKEVLDATLIHQSITGLYETRIDLSQLGGD

SEQ ID NO: 3271 - protein, 1368 aa, synthetic construct
  source 1..1368: note = Description of Artificial Sequence: Synthetic polypeptide
MDKKYSIGLDIGTNSVGWAVITDEYKVPSKKFKVLGNTDRHSIKKNLIGALLFDSGETAERTRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESIRPKRNSDKLIARKKDWDPKKYGGFLWPTVAYSVLVVAKVEKGKSKKLKSVKELLGITIMERSSFEKNPIDFLEAKGYKEVKKDLIIKLPKYSLFELENGRKRMLASAKQLQKGNELALPSKYVNFLYLASHYEKLKGSPEDNEQKQLFVEQHKHYLDEIIEQISEFSKRVILADANLDKVLSAYNKHRDKPIREQAENIIHLFTLTRLGAPRAFKYFDTTIDPKQYRSTKEVLDATLIHQSITGLYETRIDLSQLGGD

SEQ ID NO: 3272 - protein, 1121 aa, synthetic construct
  source 1..1121: note = Description of Artificial Sequence: Synthetic polypeptide
MSDLVLGLDIGIGSVGVGILNKVTGEIIHKNSRIFPAAQAENNLVRRTNRQGRRLARRKKHRRVRLNRLFEESGLITDFTKISINLNPYQLRVKGLTDELSNEELFIALKNMVKHRGISYLDDASDDGNSSVGDYAQIVKENSKQLETKTPGQIQLERYQTYGQLRGDFTVEKDGKKHRLINVFPTSAYRSEALRILQTQQEFNPQITDEFINRYLEILTGKRKYYHGPGNEKSRTDYGRYRTSGETLDNIFGILIGKCTFYPDEFRAAKASYTAQEFNLLNDLNNLTVPTETKKLSKEQKNQIINYVKNEKAMGPAKLFKYIAKLLSCDVADIKGYRIDKSGKAEIHTFEAYRKMKTLETLDIEQMDRETLDKLAYVLTLNTEREGIQEALEHEFADGSFSQKQVDELVQFRKANSSIFGKGWHNFSVKLMMELIPELYETSEEQMTILTRLGKQKTTSSSNKTKYIDEKLLTEEIYNPVVAKSVRQAIKIVNAAIKEYGDFDNIVIEMARETNEDDEKKAIQKIQKANKDEKDAAMLKAANQYNGKAELPHSVFHGHKQLATKIRLWHQQGERCLYTGKTISIHDLINNSNQFEVDHILPLSITFDDSLANKVLVYATANQEKGQRTPYQALDSMDDAWSFRELKAFVRESKTLSNKKKEYLLTEEDISKFDVRKKFIERNLVDTRYASRVVLNALQEHFRAHKIDTKVSVVRGQFTSQLRRHWGIEKTRDTYHHHAVDALIIAASSQLNLWKKQKNTLVSYSEDQLLDIETGELISDDEYKESVFKAPYQHFVDTLKSKEFEDSILFSYQVDSKFNRKISDATIYATRQAKVGKDKADETYVLGKIKDIYTQDGYDAFMKIYKKDKSKFLMYRHDPQTFEKVIEPILENYPNKQINEKGKEVPCNPFLKYKEEHGYIRKYSKKGNGPEIKSLKYYDSKLGNHIDITPKDSNNKVVLQSVSPWRADVYFNKTTGKYEILGLKYADLQFEKGTGTYKISQEKYNDIKKKEGVDSDSEFKFTLYKNDLLLVKDTETKEQQLFRFLSRTMPKQKHYVELKPYDKQKFEGGEALIKVLGNVANSGQCKKGLGKSNISIYKVRTDVLGNQHIIKNEGDKPKLDF

SEQ ID NO: 3273 - protein, 1092 aa, synthetic construct
  source 1..1092: note = Description of Artificial Sequence: Synthetic polypeptide
MAYTMGIDVGIASCGWAIVDLERQRIIDIGVRTFEKAENPKNGEALAVPRREARSSRRRLRRKKHRIERLKHMFVRNGLAVDIQHLEQTLRSQNEIDVWQLRVDGLDRMLTQKEWLRVLIHLAQRRGFQSNRKTDGSSEDGQVLVNVTENDRLMEEKDYRTVAEMMVKDEKFSDHKRNKNGNYHGVVSRSSLLVEIHTLFETQRQHHNSLASKDFELEYVNIWSAQRPVATKDQIEKMIGTCTFLPKEKRAPKASWHFQYFMLLQTINHIRITNVQGTRSLNKEEIEQVVNMALTKSKVSYHDTRKILDLSEEYQFVGLDYGKEDEKKKVESKETIIKLDDYHKLNKIFNEVELAKGETWEADDYDTVAYALTFFKDDEDIRDYLQNKYKDSKNRLVKNLANKEYTNELIGKVSTLSFRKVGHLSLKALRKIIPFLEQGMTYDKACQAAGFDFQGISKKKRSVVLPVIDQISNPVVNRALTQTRKVINALIKKYGSPETIHIETARELSKTFDERKNITKDYKENRDKNEHAKKHLSELGIINPTGLDIVKYKLWCEQQGRCMYSNQPISFERLKESGYTEVDHIIPYSRSMNDSYNNRVLVMTRENREKGNQTPFEYMGNDTQRWYEFEQRVTTNPQIKKEKRQNLLLKGFTNRRELEMLERNLNDTRYITKYLSHFISTNLEFSPSDKKKKVVNTSGRITSHLRSRWGLEKNRGQNDLHHAMDAIVIAVTSDSFIQQVTNYYKRKERRELNGDDKFPLPWKFFREEVIARLSPNPKEQIEALPNHFYSEDELADLQPIFVSRMPKRSITGEAHQAQFRRVVGKTKEGKNITAKKTALVDISYDKNGDFNMYGRETDPATYEAIKERYLEFGGNVKKAFSTDLHKPKKDGTKGPLIKSVRIMENKTLVHPVNKGKGVVYNSSIVRTDVFQRKEKYYLLPVYVTDVTKGKLPNKVIVAKKGYHDWIEVDDSFTFLFSLYPNDLIFIRQNPKKKISLKKRIESHSISDSKEVQEIHAYYKGVDSSTAAIEFIIHDGSYYAKGVGVQNLDCFEKYQVDILGNYFKVKGEKRLELETSDSNHKGKDVNSIKSTSR

SEQ ID NO: 3274 - protein, 1053 aa, synthetic construct
  source 1..1053: note = Description of Artificial Sequence: Synthetic polypeptide
MKRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEENSKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRKLINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYKNDLIKINGELYRVIGVNSDKNNLIEVNMIDITYREYLENMNDKRPPHIIKTIASKTQSIKKYSTDILGNLYEVKSKKHPQIIKKG

SEQ ID NO: 3275 - protein, 1053 aa, synthetic construct
  source 1..1053: note = Description of Artificial Sequence: Synthetic polypeptide
MKRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEENSKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRKLINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYKNDLIKINGELYRVIGVNNSTRNIVELNMIDITYREYLENMNDKRPPHIIKTIASKTQSIKKYSTDILGNLYEVKSKKHPQIIKKG

SEQ ID NO: 3276 - protein, 1053 aa, synthetic construct
  source 1..1053: note = Description of Artificial Sequence: Synthetic polypeptide
MKRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEENSKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRKLINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYKNDLIKINGELYRVIGVNSDDRNIIELNMIDITYREYLENMNDKRPPHIIKTIASKTQSIKKYSTDILGNLYEVKSKKHPQIIKKG

SEQ ID NO: 3277 - protein, 1053 aa, synthetic construct
  source 1..1053: note = Description of Artificial Sequence: Synthetic polypeptide
MKRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEENSKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRKLINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYKNDLIKINGELYRVIGVNNNRLNKIELNMIDITYREYLENMNDKRPPHIIKTIASKTQSIKKYSTDILGNLYEVKSKKHPQIIKKG

SEQ ID NO: 3278 - protein, 1084 aa, synthetic construct
  source 1..1084: note = Description of Artificial Sequence: Synthetic polypeptide
MKYHVGIDVGTFSVGLAAIEVDDAGMPIKTLSLVSHIHDSGLDPDEIKSAVTRLASSGIARRTRRLYRRKRRRLQQLDKFIQRQGWPVIELEDYSDPLYPWKVRAELAASYIADEKERGEKLSVALRHIARHRGWRNPYAKVSSLYLPDGPSDAFKAIREEIKRASGQPVPETATVGQMVTLCELGTLKLRGEGGVLSARLQQSDYAREIQEICRMQEIGQELYRKIIDVVFAAESPKGSASSRVGKDPLQPGKNRALKASDAFQRYRIAALIGNLRVRVDGEKRILSVEEKNLVFDHLVNLTPKKEPEWVTIAEILGIDRGQLIGTATMTDDGERAGARPPTHDTNRSIVNSRIAPLVDWWKTASALEQHAMVKALSNAEVDDFDSPEGAKVQAFFADLDDDVHAKLDSLHLPVGRAAYSEDTLVRLTRRMLSDGVDLYTARLQEFGIEPSWTPPTPRIGEPVGNPAVDRVLKTVSRWLESATKTWGAPERVIIEHVREGFVTEKRAREMDGDMRRRAARNAKLFQEMQEKLNVQGKPSRADLWRYQSVQRQNCQCAYCGSPITFSNSEMDHIVPRAGQGSTNTRENLVAVCHRCNQSKGNTPFAIWAKNTSIEGVSVKEAVERTRHWVTDTGMRSTDFKKFTKAVVERFQRATMDEEIDARSMESVAWMANELRSRVAQHFASHGTTVRVYRGSLTAEARRASGISGKLKFFDGVGKSRLDRRHHAIDAAVIAFTSDYVAETLAVRSNLKQSQAHRQEAPQWREFTGKDAEHRAAWRVWCQKMEKLSALLTEDLRDDRVVVMSNVRLRLGNGSAHKETIGKLSKVKLSSQLSVSDIDKASSEALWCALTREPGFDPKEGLPANPERHIRVNGTHVYAGDNIGLFPVSAGSIALRGGYAELGSSFHHARVYKITSGKKPAFAMLRVYTIDLLPYRNQDLFSVELKPQTMSMRQAEKKLRDALATGNAEYLGWLVVDDELVVDTSKIATDQVKAVEAELGTIRRWRVDGFFSPSKLRLRPLQMSKEGIKKESAPELSKIIDRPGWLPAVNKLFSDGNVTVVRRDSLGRVRLESTAHLPVTWKVQ

SEQ ID NO: 3279 - protein, 984 aa, synthetic construct
  source 1..984: note = Description of Artificial Sequence: Synthetic polypeptide
MARILAFDIGISSIGWAFSENDELKDCGVRIFTKVENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLVTPLMLEGKKYDEACNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKNFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 3280 - protein, 1087 aa, synthetic construct
  source 1..1087: note = Description of Artificial Sequence: Synthetic polypeptide
MRYKIGLDIGITSVGWAVMNLDIPRIEDLGVRIFDRAENPQTGESLALPRRLARSARRRLRRRKHRLERIRRLVIREGILTKEELDKLFEEKHEIDVWQLRVEALDRKLNNDELARVLLHLAKRRGFKSNRKSERSNKENSTMLKHIEENRAILSSYRTVGEMIVKDPKFALHKRNKGENYTNTIARDDLEREIRLIFSKQREFGNMSCTEEFENEYITIWASQRPVASKDDIEKKVGFCTFEPKEKRAPKATYTFQSFIAWEHINKLRLISPSGARGLTDEERRLLYEQAFQKNKITYHDIRTLLHLPDDTYFKGIVYDRGESRKQNENIRFLELDAYHQIRKAVDKVYGKGKSSSFLPIDFDTFGYALTLFKDDADIHSYLRNEYEQNGKRMPNLANKVYDNELIEELLNLSFTKFGHLSLKALRSILPYMEQGEVYSSACERAGYTFTGPKKKQKTMLLPNIPPIANPVVMRALTQARKVVNAIIKKYGSPVSIHIELARDLSQTFDERRKTKKEQDENRKKNETAIRQLMEYGLTLNPTGHDIVKFKLWSEQNGRCAYSLQPIEIERLLEPGYVEVDHVIPYSRSLDDSYTNKVLVLTRENREKGNRIPAEYLGVGTERWQQFETFVLTNKQFSKKKRDRLLRLHYDENEETEFKNRNLNDTRYISRFFANFIREHLKFAESDDKQKVYTVNGRVTAHLRSRWEFNKNREESDLHHAVDAVIVACTTPSDIAKVTAFYQRREQNKELAKKTEPHFPQPWPHFADELRARLSKHPKESIKALNLGNYDDQKLESLQPVFVSRMPKRSVTGAAHQETLRRYVGIDERSGKIQTVVKTKLSEIKLDASGHFPMYGKESDPRTYEAIRQRLLEHNNDPKKAFQEPLYKPKKNGEPGPVIRTVKIIDTKNQVIPLNDGKTVAYNSNIVRVDVFEKDGKYYCVPVYTMDIMKGILPNKAIEPNKPYSEWKEMTEDYTFRFSLYPNDLIRIELPREKTVKTAAGEEINVKDVFVYYKTIDSANGGLELISHDHRFSLRGVGSRTLKRFEKYQVDVLGNIYKVRGEKRVGLASSAHSKPGKTIRPLQSTRD

SEQ ID NO: 3281 - protein, 1378 aa, synthetic construct
  source 1..1378: note = Description of Artificial Sequence: Synthetic polypeptide
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRKLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLKREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEIQTVGQNGGLFDDNPKSPLEVTPSKLVPLKKELNPKKYGGYQKPTTAYPVLLITDTKQLIPISVMNKKQFEQNPVKFLRDRGYQQVGKNDFIKLPKYTLVDIGDGIKRLWASSKEIHKGNQLVVSKKSQILLYHAHHLDSDLSNDYLQNHNQQFDVLFNEIISFSKKCKLGKEHIQKIENVYSNKKNSASIEELAESFIKLLGFTQLGATSPFNFLGVKLNQKQYKGKKDYILPCTEGTLIRQSITGLYETRVDLSKIGEDSGGSGGSKRTADGSEFES

SEQ ID NO: 3282 - protein, 1082 aa, synthetic construct
  source 1..1082: note = Description of Artificial Sequence: Synthetic polypeptide
MAAFKPNSINYILGLDIGIASVGWAMVEIDEEENPIRLIDLGVRVFERAEVPKTGDSLAMARRLARSVRRLTRRRAHRLLRTRRLLKREGVLQAANFDENGLIKSLPNTPWQLRAAALDRKLTPLEWSAVLLHLIKHRGYLSQRKNEGETADKELGALLKGVAGNAHALQTGDFRTPAELALNKFEKESGHIRNQRSDYSHTFSRKDLQAELILLFEKQKEFGNPHVSGGLKEGIETLLMTQRPALSGDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSPELQDEIGTAFSLFKTDEDITGRLKDRIQPEILEALLKHISFDKFVQISLKALRRIVPLMEQGKRYDEACAEIYGDHYGKKNTEEKIYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLGRLNEKGYVEIDHALPFSRTWDDSFNNKVLVLGSENQNKGNQTPYEYFNGKDNSREWQEFKARVETSRFPRSKKQRILLQKFDEDGFKERNLNDTRYVNRFLCQFVADRMRLTGKGKKRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTLEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKGDKYYLVPIYSWQVAKGILPDRAVVQGKDEEDWQLIDDSFNFKFSLHPNDLVEVITKKARMFGYFASCHRGTGNINIRIHDLDHKIGKNGILEGIGVKTALSFQKYQIDELGKEIRPCRLKKRPPVR

SEQ ID NO: 3283 - protein, 1375 aa, synthetic construct
  source 1..1375: note = Description of Artificial Sequence: Synthetic polypeptide
MEKKYSIGLDIGTNSVGWAVITDDYKVPSKKFKVLGNTNRKSIKKNLMGALLFDSGETAEATRLKRTARRRYTRRKNRIRYLQEIFANEMAKLDDSFFQRLEESFLVEEDKKNERHPIFGNLADEVAYHRNYPTIYHLRKKLADSPEKADLRLIYLALAHIIKFRGHFLIEGKLNAENSDVAKLFYQLIQTYNQLFEESPLDEIEVDAKGILSARLSKSKRLEKLIAVFPNEKKNGLFGNIIALALGLTPNFKSNFDLTEDAKLQLSKDTYDDDLDELLGQIGDQYADLFSAAKNLSDAILLSDILRSNSEVTKAPLSASMVKRYDEHHQDLALLKTLVRQQFPEKYAEIFKDDTKNGYAGYVGIGIKHRKRTTKLATQEEFYKFIKPILEKMDGAEELLAKLNRDDLLRKQRTFDNGSIPHQIHLKELHAILRRQEEFYPFLKENREKIEKILTFRIPYYVGPLARGNSRFAWLTRKSEEAITPWNFEEVVDKGASAQSFIERMTNFDEQLPNKKVLPKHSLLYEYFTVYNELTKVKYVTERMRKPEFLSGEQKKAIVDLLFKTNRKVTVKQLKEDYFKKIECFDSVEIIGVEDRFNASLGTYHDLLKIIKDKDFLDNEENEDILEDIVLTLTLFEDREMIEERLKTYAHLFDDKVMKQLKRRHYTGWGRLSRKMINGIRDKQSGKTILDFLKSDGFSNRNFMQLIHDDSLTFKEEIEKAQVSGQGDSLHEQIADLAGSPAIKKGILQTVKIVDELVKVMGHKPENIVIEMARENQTTTKGLQQSRERKKRIEEGIKELESQILKENPVENTQLQNEKLYLYYLQNGRDMYVDQELDINRLSDYDVDHIVPQSFIKDDSIDNKVLTRSVENRGKSDNVPSEEVVKKMKNYWRQLLNAKLITQRKFDNLTKAERGGLSEADKAGFIKRQLVETRQITKHVARILDSRMNTKRDKNDKPIREVKVITLKSKLVSDFRKDFQLYKVRDINNYHHAHDAYLNAVVGTALIKKYPKLESEFVYGDYKVYDVRKMIAKSEQEIGKATAKRFFYSNIMNFFKTEVKLANGEIRKRPLIETNGETGEVVWNKEKDFATVRKVLAMPQVNIVKKTEVQTGGFSKESILSKRESAKLIPRKKGWDTRKYGGFGSPTVAYSILVVAKVEKGKAKKLKSVKVLVGITIMEKGSYEKDPIGFLEAKGYKDIKKELIFKLPKYSLFELENGRRRMLASATELQKANELVLPQHLVRLLYYTQNISATTGSNNLGYIEQHREEFKEIFEKIIDFSEKYILKNKVNSNLKSSFDEQFAVSDSILLSNSFVSLLKYTSFGASGGFTFLDLDVKQGRLRYQTVTEVLDATLIYQSITGLYETRTDLSQLGGD

SEQ ID NO: 3284 - protein, 1375 aa, synthetic construct
  source 1..1375: note = Description of Artificial Sequence: Synthetic polypeptide
MEKKYSIGLDIGTNSVGWAVITDDYKVPSKKFKVLGNTNRKSIKKNLMGALLFDSGETAEATRLKRTARRRYTRRKNRIRYLQEIFANEMAKLDDSFFQRLEESFLVEEDKKNERHPIFGNLADEVAYHRNYPTIYHLRKKLADSPEKADLRLIYLALAHIIKFRGHFLIEGKLNAENSDVAKLFYQLIQTYNQLFEESPLDEIEVDAKGILSARLSKSKRLEKLIAVFPNEKKNGLFGNIIALALGLTPNFKSNFDLTEDAKLQLSKDTYDDDLDELLGQIGDQYADLFSAAKNLSDAILLSDILRSNSEVTKAPLSASMVKRYDEHHQDLALLKTLVRQQFPEKYAEIFKDDTKNGYAGYVGADKKLRKRSGKLATEEEFYKFIKPILEKMDGAEELLAKLNRDDLLRKQRTFDNGSIPHQIHLKELHAILRRQEEFYPFLKENREKIEKILTFRIPYYVGPLARGNSRFAWLTRKSEEAITPWNFEEVVDKGASAQSFIERMTNFDEQLPNKKVLPKHSLLYEYFTVYNELTKVKYVTERMRKPEFLSGEQKKAIVDLLFKTNRKVTVKQLKEDYFKKIECFDSVEIIGVEDRFNASLGTYHDLLKIIKDKDFLDNEENEDILEDIVLTLTLFEDREMIEERLKTYAHLFDDKVMKQLKRRHYTGWGRLSRKMINGIRDKQSGKTILDFLKSDGFSNANFMQLIHDDSLTFKEEIEKAQVSGQGDSLHEQIADLAGSPAIKKGILQTVKIVDELVKVMGHKPENIVIEMARENQTTTKGLQQSRERKKRIEEGIKELESQILKENPVENTQLQNEKLYLYYLQNGRDMYVDQELDINRLSDYDVDHIVPQSFIKDDSIDNKVLTRSVENRGKSDNVPSEEVVKKMKNYWRQLLNAKLITQRKFDNLTKAERGGLSEADKAGFIKRQLVETRQITKHVARILDSRMNTKRDKNDKPIREVKVITLKSKLVSDFRKDFQLYKVRDINNYHHAHDAYLNAVVGTALIKKYPKLESEFVYGDYKVYDVRKMIAKSEQEIGKATAKRFFYSNIMNFFKTEVKLANGEIRKRPLIETNGETGEVVWNKEKDFATVRKVLAMPQVNIVKKTEVQTGGFSKESILSKRESAKLIPRKKGWDTRKYGGFGSPTVAYSILVVAKVEKGKAKKLKSVKVLVGITIMEKGSYEKDPIGFLEAKGYKDIKKELIFKLPKYSLFELENGRRRMLASAKELQKANELVLPQHLVRLLYYTQNISATTGSNNLGYIEQHREEFKEIFEKIIDFSEKYILKNKVNSNLKSSFDEQFAVSDSILLSNSFVSLLKYTSFGASGGFTFLDLDVKQGRLRYQTVTEVLDATLIYQSITGLYETRTDLSQLGGD

SEQ ID NO: 3285 - protein, 1368 aa, synthetic construct
  source 1..1368: note = Description of Artificial Sequence: Synthetic polypeptide
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMVKRYDEHHQDLTLLKALVRQQLPEKYKEIFFDQSKNGYAGYIDGGASQEEFYKFIKPILEKMDGTEELLVKLNREDLLRKQRTFDNGIIPHQIHLGELHAILRRQGDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRLRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGGHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKGNSDKLIARKKDWDPKKYGGFNSPTAAYSVLVVAKVEKGKSKKLKSVKELLGITIMERSSFEKNPIGFLEAKGYKEVKKDLIIKLPKYSLFELENGRKRMLASAGVLHKGNELALPSKYVNFLYLASHYEKLKGSPEDNEQKQLFVEQHKHYLDEIIEQISEFSKRVILADANLDKVLSAYNKHRDKPIREQAENIIHLFTLTNLGVPAAFKYFDTTIDKKRYTSTKEVLDATLIHQSITGLYETRIDLSQLGGD

SEQ ID NO: 3286 - protein, 1368 aa, synthetic construct
  source 1..1368: note = Description of Artificial Sequence: Synthetic polypeptide
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMVKRYDEHHQDLTLLKALVRQQLPEKYKEIFFDQSKNGYAGYIDGGASQEEFYKFIKPILEKMDGTEELLVKLNREDLLRKQRTFDNGIIPHQIHLGELHAILRRQGDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRLRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGGHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKGNSDKLIARKKDWDPKKYGGFNSPTVAYSVLVVAKVEKGKSKKLKSVKELLGITIMERSSFEKNPIGFLEAKGYKEVKKDLIIKLPKYSLFELENGRKRMLASASVLHKGNELALPSKYVNFLYLASHYEKLKGSSEDNKQKQLFVEQHKHYLDEIIEQISEFSKRVILADANLDKVLSAYNKHRDKPIREQAENIIHLFTLTNLGASAAFKYFDTTIGRKLYTSTKEVLDATLIHQSITGLYETRIDLSQLGGD

SEQ ID NO: 3287 - protein, 1368 aa, synthetic construct
  source 1..1368: note = Description of Artificial Sequence: Synthetic polypeptide
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMVKRYDEHHQDLTLLKALVRQQLPEKYKEIFFDQSKNGYAGYIDGGASQEEFYKFIKPILEKMDGTEELLVKLNREDLLRKQRTFDNGIIPHQIHLGELHAILRRQGDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRLRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGGHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKGNSDKLIARKKDWDPKKYGGFNSPTVAYSVLVVAKVEKGKSKKLKSVKELLGITIMERSSFEKNPIDFLEAKGYKEVKKDLIIKLPKYSLFELENGRKRMLASAGVLQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTINRKQYNTTKEVLDATLIRQSITGLYETRIDLSQLGGD

SEQ ID NO: 3288 - protein, 1368 aa, synthetic construct
  source 1..1368: note = Description of Artificial Sequence: Synthetic polypeptide
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASARELQKGNELALPSKYVNFLYLASHYEKLKGSPEDNEQKQLFVEQHKHYLDEIIEQISEFSKRVILADAQLDKVLSAYNKHRDKPIREQAENIIHLFTLTNLGAPAAFKYFDTTFKQKQYRSTKEVLDATLIHQSITGLYETRIDLSQLGGD

SEQ ID NO: 3289 - protein, 1368 aa, synthetic construct
  source 1..1368: note = Description of Artificial Sequence: Synthetic polypeptide
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFLWPTVAYSVLVVAKVEKGKSKKLKSVKELLGITIMERSSFEKNPIDFLEAKGYKEVKKDLIIKLPKYSLFELENGRKRMLASAKQLQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGD

SEQ ID NO: 3290 - protein, 1368 aa, synthetic construct
  source 1..1368: note = Description of Artificial Sequence: Synthetic polypeptide
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGD

SEQ ID NO: 3291 - protein, 1368 aa, synthetic construct
  source 1..1368: note = Description of Artificial Sequence: Synthetic polypeptide
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASARELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKEYRSTKEVLDATLIHQSITGLYETRIDLSQLGGD

SEQ ID NO: 3292 - protein, 1368 aa, synthetic construct
  source 1..1368: note = Description of Artificial Sequence: Synthetic polypeptide
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDTKLQLSKDTYDDDLDNLLAQIGDQYADLFLAAKNLSDAILLSDILRVNTEITKAPLSASMIKLYDEHHQDLTLLKALVRQQLPEKYKEIFFDQSKNGYAGYIDGGASQEEFYKFIKPILEKMDGTEELLVKLNREDLLRKQRTFDNGIIPHQIHLGELHAILRRQEDFYPFLKDNREKIEKILTFRIPYYVGPLARGNSRFAWMTRKSEETITPWNFEKVVDKGASAQSFIERMTNFDKNLPNEKVLPKHSLLYEYFTVYNELTKVKYVTEGMRKPAFLSGDQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFIQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGVLQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 3293 - protein, 1368 aa, synthetic construct
  source 1..1368: note = Description of Artificial Sequence: Synthetic polypeptide
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDTKLQLSKDTYDDDLDNLLAQIGDQYADLFLAAKNLSDAILLSDILRVNTEITKAPLSASMIKLYDEHHQDLTLLKALVRQQLPEKYKEIFFDQSKNGYAGYIDGGASQEEFYKFIKPILEKMDGTEELLVKLNREDLLRKQRTFDNGIIPHQIHLGELHAILRRQEDFYPFLKDNREKIEKILTFRIPYYVGPLARGNSRFAWMTRKSEETITPWNFEKVVDKGASAQSFIERMTNFDKNLPNEKVLPKHSLLYEYFTVYNELTKVKYVTEGMRKPAFLSGDQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFIQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESIRPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASARFLQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPRAFKYFDTTIDRKVYRSTKEVLDATLIHQSITGLYETRIDLSQLGGD

SEQ ID NO: 3294 - protein, 1122 aa, synthetic construct
  source 1..1122: note = Description of Artificial Sequence: Synthetic polypeptide
MSDLVLGLDIGIGSVGVGILNKVTGEIIHKNSRIFPAAQAENNLVRRTNRQGRRLARRKKHRRVRLNRLFEESGLITDFTKISINLNPYQLRVKGLTDELSNEELFIALKNMVKHRGISYLDDASDDGNSSVGDYAQIVKENSKQLETKTPGQIQLERYQTYGQLRGDFTVEKDGKKHRLINVFPTSAYRSEALRILQTQQEFNPQITDEFINRYLEILTGKRKYYHGPGNEKSRTDYGRYRTSGETLDNIFGILIGKCTFYPDEFRAAKASYTAQEFNLLNDLNNLTVPTETKKLSKEQKNQIINYVKNEKAMGPAKLFKYIAKLLSCDVADIKGYRIDKSGKAEIHTFEAYRKMKTLETLDIEQMDRETLDKLAYVLTLNTEREGIQEALEHEFADGSFSQKQVDELVQFRKANSSIFGKGWHNFSVKLMMELIPELYETSEEQMTILTRLGKQKTTSSSNKTKYIDEKLLTEEIYNPVVAKSVRQAIKIVNAAIKEYGDFDNIVIEMARETNEDDEKKAIQKIQKANKDEKDAAMLKAANQYNGKAELPHSVFHGHKQLATKIRLWHQQGERCLYTGKTISIHDLINNSNQFEVDHILPLSITFDDSLANKVLVYATANQEKGQRTPYQALDSMDDAWSFRELKAFVRESKTLSNKKKEYLLTEEDISKFDVRKKFIERNLVDTRYASRVVLNALQEHFRAHKIDTKVSVVRGQFTSQLRRHWGIEKTRDTYHHHAVDALIIAASSQLNLWKKQKNTLVSYSEEQLLDIETGELISDDEYKESVFKAPYQHFVDTLKSKEFEDSILFSYQVDSKFNRKISDATIYATRQAKVGKDKKDETYVLGKIKDIYTQDGYDAFMKIYKKDKSKFLMYRHDPQTFEKVIEPILENYPNKQMNEKGKEVPCNPFLKYKEEHGYIRKYSKKGNGPEIKSLKYYDSKLLGNPIDITPENSKNKVVLQSLKPWRTDVYFNKATGKYEILGLKYADLQFEKGTGTYKISQEKYNDIKKKEGVDSDSEFKFTLYKNDLLLVKDTETKEQQLFRFLSRTLPKQKHYVELKPYDKQKFEGGEALIKVLGNVANGGQCIKGLAKSNISIYKVRTDVLGNQHIIKNEGDKPKLDF

SEQ ID NO: 3295 - protein, 1122 aa, synthetic construct
  source 1..1122: note = Description of Artificial Sequence: Synthetic polypeptide
MSDLVLGLDIGIGSVGVGILNKVTGEIIHKNSRIFPAAQAENNLVRRTNRQGRRLARRKKHRRVRLNRLFEESGLITDFTKISINLNPYQLRVKGLTDELSNEELFIALKNMVKHRGISYLDDASDDGNSSVGDYAQIVKENSKQLETKTPGQIQLERYQTYGQLRGDFTVEKDGKKHRLINVFPTSAYRSEALRILQTQQEFNPQITDEFINRYLEILTGKRKYYHGPGNEKSRTDYGRYRTSGETLDNIFGILIGKCTFYPDEFRAAKASYTAQEFNLLNDLNNLTVPTETKKLSKEQKNQIINYVKNEKAMGPAKLFKYIAKLLSCDVADIKGYRIDKSGKAEIHTFEAYRKMKTLETLDIEQMDRETLDKLAYVLTLNTEREGIQEALEHEFADGSFSQKQVDELVQFRKANSSIFGKGWHNFSVKLMMELIPELYETSEEQMTILTRLGKQKTTSSSNKTKYIDEKLLTEEIYNPVVAKSVRQAIKIVNAAIKEYGDFDNIVIEMARETNEDDEKKAIQKIQKANKDEKDAAMLKAANQYNGKAELPHSVFHGHKQLATKIRLWHQQGERCLYTGKTISIHDLINNSNQFEVDHILPLSITFDDSLANKVLVYATANQEKGQRTPYQALDSMDDAWSFRELKAFVRESKTLSNKKKEYLLTEEDISKFDVRKKFIERNLVDTRYASRVVLNALQEHFRAHKIDTKVSVVRGQFTSQLRRHWGIEKTRDTYHHHAVDALIIAASSQLNLWKKQKNTLVSYSEEQLLDIETGELISDDEYKESVFKAPYQHFVDTLKSKEFEDSILFSYQVDSKFNRKISDATIYATRQAKVGKDKKDETYVLGKIKDIYTQDGYDAFMKIYKKDKSKFLMYRHDPQTFEKVIEPILENYPNKQMNEKGKEVPCNPFLKYKEEHGYIRKYSKKGNGPEIKSLKYYDSKLLGNPIDITPENSKNKVVLQSLKPWRTDVYFNKNTGKYEILGLKYADLQFEKKTGTYKISQEKYNGIMKEEGVDSDSEFKFTLYKNDLLLVKDTETKEQQLFRFLSRTMPNVKYYVELKPYSKDKFEKNESLIEILGSADKSGRCIKGLGKSNISIYKVRTDVLGNQHIIKNEGDKPKLDF

SEQ ID NO: 3296 - protein, 1120 aa, synthetic construct
  source 1..1120: note = Description of Artificial Sequence: Synthetic polypeptide
MSDLVLGLDIGIGSVGVGILNKVTGEIIHKNSRIFPAAQAENNLVRRTNRQGRRLARRKKHRRVRLNRLFEESGLITDFTKISINLNPYQLRVKGLTDELSNEELFIALKNMVKHRGISYLDDASDDGNSSVGDYAQIVKENSKQLETKTPGQIQLERYQTYGQLRGDFTVEKDGKKHRLINVFPTSAYRSEALRILQTQQEFNPQITDEFINRYLEILTGKRKYYHGPGNEKSRTDYGRYRTSGETLDNIFGILIGKCTFYPDEFRAAKASYTAQEFNLLNDLNNLTVPTETKKLSKEQKNQIINYVKNEKAMGPAKLFKYIAKLLSCDVADIKGYRIDKSGKAEIHTFEAYRKMKTLETLDIEQMDRETLDKLAYVLTLNTEREGIQEALEHEFADGSFSQKQVDELVQFRKANSSIFGKGWHNFSVKLMMELIPELYETSEEQMTILTRLGKQKTTSSSNKTKYIDEKLLTEEIYNPVVAKSVRQAIKIVNAAIKEYGDFDNIVIEMARETNEDDEKKAIQKIQKANKDEKDAAMLKAANQYNGKAELPHSVFHGHKQLATKIRLWHQQGERCLYTGKTISIHDLINNSNQFEVDHILPLSITFDDSLANKVLVYATANQEKGQRTPYQALDSMDDAWSFRELKAFVRESKTLSNKKKEYLLTEEDISKFDVRKKFIERNLVDTRYASRVVLNALQEHFRAHKIDTKVSVVRGQFTSQLRRHWGIEKTRDTYHHHAVDALIIAASSQLNLWKKQKNTLVSYSEDQLLDIETGELISDDEYKESVFKAPYQHFVDTLKSKEFEDSILFSYQVDSKFNRKISDATIYATRQAKVGKDKADETYVLGKIKDIYTQDGYDAFMKIYKKDKSKFLMYRHDPQTFEKVIEPILENYPNKQINEKGKEVPCNPFLKYKEEHGYIRKYSKKGNGPEIKSLKYYDSKLGNHIDITPKDSNNKVVLQSLKPWRTDVYFNKNTGKYEILGLKYSDMQFEKGTGKYSISKEQYENIKVREGVDENSEFKFTLYKNDLLLLKDSENGEQILLRFTSRNDTSKHYVELKPYNRQKFEGSEYLIKSLGTVAKGGQCIKGLGKSNISIYKVRTDVLGNQHIIKNEGDKPKLDF

SEQ ID NO: 3297 - protein, 1120 aa, synthetic construct
  source 1..1120: note = Description of Artificial Sequence: Synthetic polypeptide
MSDLVLGLDIGIGSVGVGILNKVTGEIIHKNSRIFPAAQAENNLVRRTNRQGRRLARRKKHRRVRLNRLFEESGLITDFTKISINLNPYQLRVKGLTDELSNEELFIALKNMVKHRGISYLDDASDDGNSSVGDYAQIVKENSKQLETKTPGQIQLERYQTYGQLRGDFTVEKDGKKHRLINVFPTSAYRSEALRILQTQQEFNPQITDEFINRYLEILTGKRKYYHGPGNEKSRTDYGRYRTSGETLDNIFGILIGKCTFYPDEFRAAKASYTAQEFNLLNDLNNLTVPTETKKLSKEQKNQIINYVKNEKAMGPAKLFKYIAKLLSCDVADIKGYRIDKSGKAEIHTFEAYRKMKTLETLDIEQMDRETLDKLAYVLTLNTEREGIQEALEHEFADGSFSQKQVDELVQFRKANSSIFGKGWHNFSVKLMMELIPELYETSEEQMTILTRLGKQKTTSSSNKTKYIDEKLLTEEIYNPVVAKSVRQAIKIVNAAIKEYGDFDNIVIEMARETNEDDEKKAIQKIQKANKDEKDAAMLKAANQYNGKAELPHSVFHGHKQLATKIRLWHQQGERCLYTGKTISIHDLINNSNQFEVDHILPLSITFDDSLANKVLVYATANQEKGQRTPYQALDSMDDAWSFRELKAFVRESKTLSNKKKEYLLTEEDISKFDVRKKFIERNLVDTRYASRVVLNALQEHFRAHKIDTKVSVVRGQFTSQLRRHWGIEKTRDTYHHHAVDALIIAASSQLNLWKKQKNTLVSYSEDQLLDIETGELISDDEYKESVFKAPYQHFVDTLKSKEFEDSILFSYQVDSKFNRKISDATIYATRQAKVGKDKADETYVLGKIKDIYTQDGYDAFMKIYKKDKSKFLMYRHDPQTFEKVIEPILENYPNKQINEKGKEVPCNPFLKYKEEHGYIRKYSKKGNGPEIKSLKYYDSKLGNHIDITPKDSNNKVVLQSLKPWRTDVYFNKNTGKYEILGLKYSDMQFEKGTGKYSISKEQYENIKVREGVDENSEFKFTLYKNDLLLLKDSENGEQILLRFTSRNDTSKHYVELKPYNRQKFEGSEYLIKSLGTVVKGGRCIKGLGKSNISIYKVRTDVLGNQHIIKNEGDKPKLDF

SEQ ID NO: 3298 - protein, 6 aa, synthetic construct
  source 1..6: note = Description of Artificial Sequence: Synthetic peptide
GGSGGS

SEQ ID NO: 3299 - protein, 9 aa, synthetic construct
  source 1..9: note = Description of Artificial Sequence: Synthetic peptide
GGSGGSGGS

SEQ ID NO: 3300 - protein, 12 aa, synthetic construct
  source 1..12: note = Description of Artificial Sequence: Synthetic peptide
GGSGGSGGSGGS

SEQ ID NO: 3301 - protein, 15 aa, synthetic construct
  source 1..15: note = Description of Artificial Sequence: Synthetic peptide
GGSGGSGGSGGSGGS

SEQ ID NO: 3302 - protein, 18 aa, synthetic construct
  source 1..18: note = Description of Artificial Sequence: Synthetic peptide
GGSGGSGGSGGSGGSGGS

SEQ ID NO: 3303 - protein, 10 aa, synthetic construct
  source 1..10: note = Description of Artificial Sequence: Synthetic peptide
GGGGSGGGGS

SEQ ID NO: 3304 - protein, 15 aa, synthetic construct
  source 1..15: note = Description of Artificial Sequence: Synthetic peptide
GGGGSGGGGSGGGGS

SEQ ID NO: 3305 - protein, 20 aa, synthetic construct
  source 1..20: note = Description of Artificial Sequence: Synthetic peptide
GGGGSGGGGSGGGGSGGGGS

SEQ ID NO: 3306 - protein, 25 aa, synthetic construct
  source 1..25: note = Description of Artificial Sequence: Synthetic peptide
GGGGSGGGGSGGGGSGGGGSGGGGS

SEQ ID NO: 3307 - protein, 30 aa, synthetic construct
  source 1..30: note = Description of Artificial Sequence: Synthetic polypeptide
GGGGSGGGGSGGGGSGGGGSGGGGSGGGGS

SEQ ID NO: 3308 - protein, 4 aa, synthetic construct
  source 1..4: note = Description of Artificial Sequence: Synthetic peptide
GGGG

SEQ ID NO: 3309 - protein, 5 aa, synthetic construct
  source 1..5: note = Description of Artificial Sequence: Synthetic peptide
GGGGG

SEQ ID NO: 3310 - protein, 6 aa, synthetic construct
  source 1..6: note = Description of Artificial Sequence: Synthetic peptide
GGGGGG

SEQ ID NO: 3311 - protein, 7 aa, synthetic construct
  source 1..7: note = Description of Artificial Sequence: Synthetic peptide
GGGGGGG

SEQ ID NO: 3312 - protein, 8 aa, synthetic construct
  source 1..8: note = Description of Artificial Sequence: Synthetic peptide
GGGGGGGG

SEQ ID NO: 3313 - protein, 9 aa, synthetic construct
  source 1..9: note = Description of Artificial Sequence: Synthetic peptide
GSSGSSGSS

SEQ ID NO: 3314 - protein, 12 aa, synthetic construct
  source 1..12: note = Description of Artificial Sequence: Synthetic peptide
GSSGSSGSSGSS

SEQ ID NO: 3315 - protein, 15 aa, synthetic construct
  source 1..15: note = Description of Artificial Sequence: Synthetic peptide
GSSGSSGSSGSSGSS

SEQ ID NO: 3316 - protein, 18 aa, synthetic construct
  source 1..18: note = Description of Artificial Sequence: Synthetic peptide
GSSGSSGSSGSSGSSGSS

SEQ ID NO: 3317 - protein, 10 aa, synthetic construct
  source 1..10: note = Description of Artificial Sequence: Synthetic peptide
EAAAKEAAAK

SEQ ID NO: 3318 - protein, 15 aa, synthetic construct
  source 1..15: note = Description of Artificial Sequence: Synthetic peptide
EAAAKEAAAKEAAAK

SEQ ID NO: 3319 - protein, 20 aa, synthetic construct
  source 1..20: note = Description of Artificial Sequence: Synthetic peptide
EAAAKEAAAKEAAAKEAAAK

SEQ ID NO: 3320 - protein, 25 aa, synthetic construct
  source 1..25: note = Description of Artificial Sequence: Synthetic peptide
EAAAKEAAAKEAAAKEAAAKEAAAK

SEQ ID NO: 3321 - protein, 30 aa, synthetic construct
  source 1..30: note = Description of Artificial Sequence: Synthetic polypeptide
EAAAKEAAAKEAAAKEAAAKEAAAKEAAAK

SEQ ID NO: 3322 - protein, 5 aa, synthetic construct
  source 1..5: note = Description of Artificial Sequence: Synthetic peptide
PAPAP

SEQ ID NO: 3323 - protein, 7 aa, synthetic construct
  source 1..7: note = Description of Artificial Sequence: Synthetic peptide
PAPAPAP

SEQ ID NO: 3324 - protein, 9 aa, synthetic construct
  source 1..9: note = Description of Artificial Sequence: Synthetic peptide
PAPAPAPAP

SEQ ID NO: 3325 - protein, 11 aa, synthetic construct
  source 1..11: note = Description of Artificial Sequence: Synthetic peptide
PAPAPAPAPAP

SEQ ID NO: 3326 - protein, 13 aa, synthetic construct
  source 1..13: note = Description of Artificial Sequence: Synthetic peptide
PAPAPAPAPAPAP

SEQ ID NO: 3327 - protein, 6 aa, synthetic construct
  source 1..6: note = Description of Artificial Sequence: Synthetic peptide
GGSGGG

SEQ ID NO: 3328 - protein, 6 aa, synthetic construct
  source 1..6: note = Description of Artificial Sequence: Synthetic peptide
GGGGGS

SEQ ID NO: 3329 - protein, 6 aa, synthetic construct
  source 1..6: note = Description of Artificial Sequence: Synthetic peptide
GGSGSS

SEQ ID NO: 3330 - protein, 6 aa, synthetic construct
  source 1..6: note = Description of Artificial Sequence: Synthetic peptide
GSSGGS

SEQ ID NO: 3331 - protein, 8 aa, synthetic construct
  source 1..8: note = Description of Artificial Sequence: Synthetic peptide
GGSEAAAK

SEQ ID NO: 3332 - protein, 8 aa, synthetic construct
  source 1..8: note = Description of Artificial Sequence: Synthetic peptide
EAAAKGGS

SEQ ID NO: 3333 - protein, 6 aa, synthetic construct
  source 1..6: note = Description of Artificial Sequence: Synthetic peptide
GGSPAP

SEQ ID NO: 3334 - protein, 6 aa, synthetic construct
  source 1..6: note = Description of Artificial Sequence: Synthetic peptide
PAPGGS

SEQ ID NO: 3335 - protein, 6 aa, synthetic construct
  source 1..6: note = Description of Artificial Sequence: Synthetic peptide
GGGGSS

SEQ ID NO: 3336 - protein, 6 aa, synthetic construct
  source 1..6: note = Description of Artificial Sequence: Synthetic peptide
GSSGGG

SEQ ID NO: 3337 - protein, 8 aa, synthetic construct
  source 1..8: note = Description of Artificial Sequence: Synthetic peptide
GGGEAAAK

SEQ ID NO: 3338 - protein, 8 aa, synthetic construct
  source 1..8: note = Description of Artificial Sequence: Synthetic peptide
EAAAKGGG

SEQ ID NO: 3339 - protein, 6 aa, synthetic construct
  source 1..6: note = Description of Artificial Sequence: Synthetic peptide
GGGPAP

SEQ ID NO: 3340 - protein, 6 aa, synthetic construct
  source 1..6: note = Description of Artificial Sequence: Synthetic peptide
PAPGGG

SEQ ID NO: 3341 - protein, 8 aa, synthetic construct
  source 1..8: note = Description of Artificial Sequence: Synthetic peptide
GSSEAAAK

SEQ ID NO: 3342 - protein, 8 aa, synthetic construct
  source 1..8: note = Description of Artificial Sequence: Synthetic peptide
EAAAKGSS

SEQ ID NO: 3343 - protein, 6 aa, synthetic construct
  source 1..6: note = Description of Artificial Sequence: Synthetic peptide
GSSPAP

SEQ ID NO: 3344 - protein, 6 aa, synthetic construct
  source 1..6: note = Description of Artificial Sequence: Synthetic peptide
PAPGSS

SEQ ID NO: 3345 - protein, 8 aa, synthetic construct
  source 1..8: note = Description of Artificial Sequence: Synthetic peptide
EAAAKPAP

SEQ ID NO: 3346 - protein, 8 aa, synthetic construct
  source 1..8: note = Description of Artificial Sequence: Synthetic peptide
PAPEAAAK

SEQ ID NO: 3347 - protein, 9 aa, synthetic construct
  source 1..9: note = Description of Artificial Sequence: Synthetic peptide
GGSGGGGSS

SEQ ID NO: 3348 - protein, 9 aa, synthetic construct
  source 1..9: note = Description of Artificial Sequence: Synthetic peptide
GGSGSSGGG

SEQ ID NO: 3349 - protein, 9 aa, synthetic construct
  source 1..9: note = Description of Artificial Sequence: Synthetic peptide
GGGGGSGSS

SEQ ID NO: 3350 - protein, 9 aa, synthetic construct
  source 1..9: note = Description of Artificial Sequence: Synthetic peptide
GGGGSSGGS

SEQ ID NO: 3351 - protein, 9 aa, synthetic construct
  source 1..9: note = Description of Artificial Sequence: Synthetic peptide
GSSGGSGGG

SEQ ID NO: 3352 - protein, 9 aa, synthetic construct
  source 1..9: note = Description of Artificial Sequence: Synthetic peptide
GSSGGGGGS

SEQ ID NO: 3353 - protein, 11 aa, synthetic construct
  source 1..11: note = Description of Artificial Sequence: Synthetic peptide
GGSGGGEAAAK

SEQ ID NO: 3354 - protein, 11 aa, synthetic construct
  source 1..11: note = Description of Artificial Sequence: Synthetic peptide
GGSEAAAKGGG

SEQ ID NO: 3355 - protein, 11 aa, synthetic construct
  source 1..11: note = Description of Artificial Sequence: Synthetic peptide
GGGGGSEAAAK

SEQ ID NO: 3356 - protein, 11 aa, synthetic construct
  source 1..11: note = Description of Artificial Sequence: Synthetic peptide
GGGEAAAKGGS

SEQ ID NO: 3357 - protein, 11 aa, synthetic construct
  source 1..11: note = Description of Artificial Sequence: Synthetic peptide
EAAAKGGSGGG

SEQ ID NO: 3358 - protein, 11 aa, synthetic construct
  source 1..11: note = Description of Artificial Sequence: Synthetic peptide
EAAAKGGGGGS

SEQ ID NO: 3359 - protein, 9 aa, synthetic construct
  source 1..9: note = Description of Artificial Sequence: Synthetic peptide
GGSGGGPAP

SEQ ID NO: 3360 - protein, 9 aa, synthetic construct
  source 1..9: note = Description of Artificial Sequence: Synthetic peptide
GGSPAPGGG

SEQ ID NO: 3361 - protein, 9 aa, synthetic construct
  source 1..9: note = Description of Artificial Sequence: Synthetic peptide
GGGGGSPAP

SEQ ID NO: 3362 - protein, 9 aa, synthetic construct
  source 1..9: note = Description of Artificial Sequence: Synthetic peptide
GGGPAPGGS

SEQ ID NO: 3363 - protein, 9 aa, synthetic construct
  source 1..9: note = Description of Artificial Sequence: Synthetic peptide
PAPGGSGGG

SEQ ID NO: 3364 - protein, 9 aa, synthetic construct
  source 1..9: note = Description of Artificial Sequence: Synthetic peptide
PAPGGGGGS

SEQ ID NO: 3365 - protein, 11 aa, synthetic construct
  source 1..11: note = Description of Artificial Sequence: Synthetic peptide
GGSGSSEAAAK

SEQ ID NO: 3366 - protein, 11 aa, synthetic construct
  source 1..11: note = Description of Artificial Sequence: Synthetic peptide
GGSEAAAKGSS

SEQ ID NO: 3367 - protein, 11 aa, synthetic construct
  source 1..11: note = Description of Artificial Sequence: Synthetic peptide
GSSGGSEAAAK

SEQ ID NO: 3368 - protein, 11 aa, synthetic construct
  source 1..11: note = Description of Artificial Sequence: Synthetic peptide
GSSEAAAKGGS

SEQ ID NO: 3369 - protein, 11 aa, synthetic construct
  source 1..11: note = Description of Artificial Sequence: Synthetic peptide
EAAAKGGSGSS

SEQ ID NO: 3370 - protein, 11 aa, synthetic construct
  source 1..11: note = Description of Artificial Sequence: Synthetic peptide
EAAAKGSSGGS

SEQ ID NO: 3371 - protein, 9 aa, synthetic construct
  source 1..9: note = Description of Artificial Sequence: Synthetic peptide
GGSGSSPAP

SEQ ID NO: 3372 - protein, 9 aa, synthetic construct
  source 1..9: note = Description of Artificial Sequence: Synthetic peptide
GGSPAPGSS

SEQ ID NO: 3373 - protein, 9 aa, synthetic construct
  source 1..9: note = Description of Artificial Sequence: Synthetic peptide
GSSGGSPAP

SEQ ID NO: 3374 - protein, 9 aa, synthetic construct
  source 1..9: note = Description of Artificial Sequence: Synthetic peptide
GSSPAPGGS

SEQ ID NO: 3375 - protein, 9 aa, synthetic construct
  source 1..9: note = Description of Artificial Sequence: Synthetic peptide
PAPGGSGSS

SEQ ID NO: 3376 - protein, 9 aa, synthetic construct
  source 1..9: note = Description of Artificial Sequence: Synthetic peptide
PAPGSSGGS

SEQ ID NO: 3377 - protein, 11 aa, synthetic construct
  source 1..11: note = Description of Artificial Sequence: Synthetic peptide
GGSEAAAKPAP

SEQ ID NO: 3378 - protein, 11 aa, synthetic construct
  source 1..11: note = Description of Artificial Sequence: Synthetic peptide
GGSPAPEAAAK

SEQ ID NO: 3379 - protein, 11 aa, synthetic construct
  source 1..11: note = Description of Artificial Sequence: Synthetic peptide
EAAAKGGSPAP

SEQ ID NO: 3380 - protein, 11 aa, synthetic construct
  source 1..11: note = Description of Artificial Sequence: Synthetic peptide
EAAAKPAPGGS

SEQ ID NO: 3381 - protein, 11 aa, synthetic construct
  source 1..11: note = Description of Artificial Sequence: Synthetic peptide
PAPGGSEAAAK

SEQ ID NO: 3382 - protein, 11 aa, synthetic construct
  source 1..11: note = Description of Artificial Sequence: Synthetic peptide
PAPEAAAKGGS

SEQ ID NO: 3383 - protein, 11 aa, synthetic construct
  source 1..11: note = Description of Artificial Sequence: Synthetic peptide
GGGGSSEAAAK

SEQ ID NO: 3384 - protein, 11 aa, synthetic construct
  source 1..11: note = Description of Artificial Sequence: Synthetic peptide
GGGEAAAKGSS

SEQ ID NO: 3385 - protein, 11 aa, synthetic construct
  source 1..11: note = Description of Artificial Sequence: Synthetic peptide
GSSGGGEAAAK

SEQ ID NO: 3386 - protein, 11 aa, synthetic construct
  source 1..11: note = Description of Artificial Sequence: Synthetic peptide
GSSEAAAKGGG

SEQ ID NO: 3387 - protein, 11 aa, synthetic construct
  source 1..11: note = Description of Artificial Sequence: Synthetic peptide
EAAAKGGGGSS

SEQ ID NO: 3388 - protein, 11 aa, synthetic construct
  source 1..11: note = Description of Artificial Sequence: Synthetic peptide
EAAAKGSSGGG

SEQ ID NO: 3389 - protein, 9 aa, synthetic construct
  source 1..9: note = Description of Artificial Sequence: Synthetic peptide
GGGGSSPAP

SEQ ID NO: 3390 - protein, 9 aa, synthetic construct
  source 1..9: note = Description of Artificial Sequence: Synthetic peptide
GGGPAPGSS

SEQ ID NO: 3391 - protein, 9 aa, synthetic construct
  source 1..9: note = Description of Artificial Sequence: Synthetic peptide
GSSGGGPAP

SEQ ID NO: 3392 - protein, 9 aa, synthetic construct
  source 1..9: note = Description of Artificial Sequence: Synthetic peptide
GSSPAPGGG

SEQ ID NO: 3393 - protein, 9 aa, synthetic construct
  source 1..9: note = Description of Artificial Sequence: Synthetic peptide
PAPGGGGSS

SEQ ID NO: 3394 - protein, 9 aa, synthetic construct
  source 1..9: note = Description of Artificial Sequence: Synthetic peptide
PAPGSSGGG

SEQ ID NO: 3395 - protein, 11 aa, synthetic construct
  source 1..11: note = Description of Artificial Sequence: Synthetic peptide
GGGEAAAKPAP

SEQ ID NO: 3396 - protein, 11 aa, synthetic construct
  source 1..11: note = Description of Artificial Sequence: Synthetic peptide
GGGPAPEAAAK

SEQ ID NO: 3397 - protein, 11 aa, synthetic construct
  source 1..11: note = Description of Artificial Sequence: Synthetic peptide
EAAAKGGGPAP

SEQ ID NO: 3398 - protein, 11 aa, synthetic construct
  source 1..11: note = Description of Artificial Sequence: Synthetic peptide
EAAAKPAPGGG

SEQ ID NO: 3399 - protein, 11 aa, synthetic construct
  source 1..11: note = Description of Artificial Sequence: Synthetic peptide
PAPGGGEAAAK

SEQ ID NO: 3400 - protein, 11 aa, synthetic construct
  source 1..11: note = Description of Artificial Sequence: Synthetic peptide
PAPEAAAKGGG

SEQ ID NO: 3401 - protein, 11 aa, synthetic construct
  source 1..11: note = Description of Artificial Sequence: Synthetic peptide
GSSEAAAKPAP

SEQ ID NO: 3402 - protein, 11 aa, synthetic construct
  source 1..11: note = Description of Artificial Sequence: Synthetic peptide
GSSPAPEAAAK

SEQ ID NO: 3403 - protein, 11 aa, synthetic construct
  source 1..11: note = Description of Artificial Sequence: Synthetic peptide
EAAAKGSSPAP

SEQ ID NO: 3404 - protein, 11 aa, synthetic construct
  source 1..11: note = Description of Artificial Sequence: Synthetic peptide
EAAAKPAPGSS

SEQ ID NO: 3405 - protein, 11 aa, synthetic construct
  source 1..11: note = Description of Artificial Sequence: Synthetic peptide
PAPGSSEAAAK

SEQ ID NO: 3406 - protein, 11 aa, synthetic construct
  source 1..11: note = Description of Artificial Sequence: Synthetic peptide
PAPEAAAKGSS

SEQ ID NO: 3407 - protein, 46 aa, synthetic construct
  source 1..46: note = Description of Artificial Sequence: Synthetic polypeptide
AEAAAKEAAAKEAAAKEAAAKALEAEAAAKEAAAKEAAAKEAAAKA

SEQ ID NO: 3408 - protein, 15 aa, synthetic construct
  source 1..15: note = Description of Artificial Sequence: Synthetic peptide
GGGGSEAAAKGGGGS

SEQ ID NO: 3409 - protein, 15 aa, synthetic construct
  source 1..15: note = Description of Artificial Sequence: Synthetic peptide
EAAAKGGGGSEAAAK

SEQ ID NO: 3410 - protein, 12 aa, synthetic construct
  source 1..12: note = Description of Artificial Sequence: Synthetic peptide
GSAGSAAGSGEF

SEQ ID NO: 3411 - protein, 30 aa, Rattus norvegicus
AHFKISGEKRPSTDPGKKAKNPKKKKKKDP

SEQ ID NO: 3412 - protein, 12 aa, Saccharomyces cerevisiae
AHRAKKMSKTHA

SEQ ID NO: 3413 - protein, 14 aa, unidentified
  source 1..14: note = Description of Unknown:NLS sequence
ASPEYVNLPINGNG

SEQ ID NO: 3414 - protein, 7 aa, unidentified
  source 1..7: note = Description of Unknown:NLS sequence
CTKRPRW

SEQ ID NO: 3415 - protein, 16 aa, unidentified
  source 1..16: note = Description of Unknown:NLS sequence
DKAKRVSRNKSEKKRR

SEQ ID NO: 3416 - protein, 15 aa, unidentified
  source 1..15: note = Description of Unknown:NLS sequence
EELRLKEELLKGIYA

SEQ ID NO: 3417 - protein, 16 aa, Caenorhabditis elegans
EEQLRRRKNSRLNNTG

SEQ ID NO: 3418 - protein, 24 aa, unidentified
  source 1..24: note = Description of Unknown:NLS sequence
EVLKVIRTGKRKKKAWKRMVTKVC

SEQ ID NO: 3419 - protein, 15 aa, unidentified
  source 1..15: note = Description of Unknown:NLS sequence
HHHHHHHHHHHHQPH

SEQ ID NO: 3420 - protein, 17 aa, unidentified
  source 1..17: note = Description of Unknown:NLS sequence
HKKKHPDASVNFSEFSK

SEQ ID NO: 3421 - protein, 6 aa, Oryza sativa
HKRTKK

SEQ ID NO: 3422 - protein, 29 aa, unidentified
  source 1..29: note = Description of Unknown:NLS sequence
IINGRKLKLKKSRRRSSQTSNNSFTSRRS

SEQ ID NO: 3423 - protein, 8 aa, Oryza sativa
KAEQERRK

SEQ ID NO: 3424 - protein, 18 aa, unidentified
  source 1..18: note = Description of Unknown:NLS sequence
KEKRKRREELFIEQKKRK

SEQ ID NO: 3425 - protein, 14 aa, Mus musculus
KKGKDEWFSRGKKP

SEQ ID NO: 3426 - protein, 12 aa, Homo sapiens
KKGPSVQKRKKT

SEQ ID NO: 3427 - protein, 16 aa, unidentified
  source 1..16: note = Description of Unknown:NLS sequence
KKKTVINDLLHYKKEK

SEQ ID NO: 3428 - protein, 17 aa, unidentified
  source 1..17: note = Description of Unknown:NLS sequence
KKNGGKGKNKPSAKIKK

SEQ ID NO: 3429 - protein, 13 aa, unidentified
  source 1..13: note = Description of Unknown:NLS sequence
KKPKWDDFKKKKK

SEQ ID NO: 3430 - protein, 6 aa, unidentified
  source 1..6: note = Description of Unknown:NLS sequence
KKRKKD

SEQ ID NO: 3431 - protein, 9 aa, unidentified
  source 1..9: note = Description of Unknown:NLS sequence
KKRRKRRRK

SEQ ID NO: 3432 - protein, 9 aa, unidentified
  source 1..9: note = Description of Unknown:NLS sequence
KKRRRRARK

SEQ ID NO: 3433 - protein, 7 aa, Homo sapiens
KKSKRGR

SEQ ID NO: 3434 - protein, 8 aa, Zea mays
KKSRKRGS

SEQ ID NO: 3435 - protein, 17 aa, unidentified
  source 1..17: note = Description of Unknown:NLS sequence
KKSTALSRELGKIMRRR

SEQ ID NO: 3436 - protein, 17 aa, Dictyostelium discoideum
KKSYQDPEIIAHSRPRK

SEQ ID NO: 3437 - protein, 17 aa, unidentified
  source 1..17: note = Description of Unknown:NLS sequence
KKTGKNRKLKSKRVKTR

SEQ ID NO: 3438 - protein, 17 aa, Oryza sativa
KKVSIAGQSGKLWRWKR

SEQ ID NO: 3439 - protein, 20 aa, unidentified
  source 1..20: note = Description of Unknown:NLS sequence
KKYENVVIKRSPRKRGRPRK

SEQ ID NO: 3440 - protein, 6 aa, unidentified
  source 1..6: note = Description of Unknown:NLS sequence
KNKKRK

SEQ ID NO: 3441 - protein, 6 aa, unidentified
  source 1..6: note = Description of Unknown:NLS sequence
KPKKKR

SEQ ID NO: 3442 - protein, 19 aa, Danio rerio
KRAMKDDSHGNSTSPKRRK

SEQ ID NO: 3443 - protein, 17 aa, Homo sapiens
KRANSNLVAAYEKAKKK

SEQ ID NO: 3444 - protein, 22 aa, unidentified
  source 1..22: note = Description of Unknown:NLS sequence
KRASEDTTSGSPPKKSSAGPKR

SEQ ID NO: 3445 - protein, 16 aa, unidentified
  source 1..16: note = Description of Unknown:NLS sequence
KRFKRRWMVRKMKTKK

SEQ ID NO: 3446 - protein, 16 aa, Homo sapiens
KRGLNSSFETSPKKVK

SEQ ID NO: 3447 - protein, 20 aa, unidentified
  source 1..20: note = Description of Unknown:NLS sequence
KRGNSSIGPNDLSKRKQRKK

SEQ ID NO: 3448 - protein, 23 aa, unidentified
  source 1..23: note = Description of Unknown:NLS sequence
KRIHSVSLSQSQIDPSKKVKRAK

SEQ ID NO: 3449 - protein, 15 aa, Homo sapiens
KRKGKLKNKGSKRKK

SEQ ID NO: 3450 - protein, 13 aa, Homo sapiens
KRRRRRRREKRKR

SEQ ID NO: 3451 - protein, 18 aa, Mus musculus
KRSNDRTYSPEEEKQRRA

SEQ ID NO: 3452 - protein, 21 aa, unidentified
  source 1..21: note = Description of Unknown:NLS sequence
KRTVATNGDASGAHRAKKMSK

SEQ ID NO: 3453 - protein, 20 aa, unidentified
  source 1..20: note = Description of Unknown:NLS sequence
KRVYNKGEDEQEHLPKGKKR

SEQ ID NO: 3454 - protein, 18 aa, unidentified
  source 1..18: note = Description of Unknown:NLS sequence
KSGKAPRRRAVSMDNSNK

SEQ ID NO: 3455 - protein, 19 aa, Homo sapiens
KVNFLDMSLDDIIIYKELE

SEQ ID NO: 3456 - protein, 15 aa, Tomato yellow leaf curl China virus
KVQHRIAKKTTRRRR

SEQ ID NO: 3457 - protein, 8 aa, unidentified
  source 1..8: note = Description of Unknown:NLS sequence
LSPSLSPL

SEQ ID NO: 3458 - protein, 52 aa, unidentified
  source 1..52: note = Description of Unknown:NLS sequence
MPQNEYIELHRKRYGYRLDYHEKKRKKESREAHERSKKAKKMIGLKAKLYHK

SEQ ID NO: 3459 - protein, 10 aa, unidentified
  source 1..10: note = Description of Unknown:NLS sequence
MVQLRPRASR

SEQ ID NO: 3460 - protein, 24 aa, Caenorhabditis elegans
NNKLLAKRRKGGASPKDDPMDDIK

SEQ ID NO: 3461 - protein, 20 aa, unidentified
  source 1..20: note = Description of Unknown:NLS sequence
NYKRPMDGTYGPPAKRHEGE

SEQ ID NO: 3462 - protein, 19 aa, unidentified
  source 1..19: note = Description of Unknown:NLS sequence
PDTKRAKLDSSETTMVKKK

SEQ ID NO: 3463 - protein, 7 aa, unidentified
  source 1..7: note = Description of Unknown:NLS sequence
PEKRTKI

SEQ ID NO: 3464 - protein, 8 aa, unidentified
  source 1..8: note = Description of Unknown:NLS sequence
PGGRGKKK

SEQ ID NO: 3465 - protein, 18 aa, unidentified
  source 1..18: note = Description of Unknown:NLS sequence
PGKMDKGEHRQERRDRPY

SEQ ID NO: 3466 - protein, 11 aa, Physarum polycephalum
PKKGDKYDKTD

SEQ ID NO: 3467 - protein, 7 aa, unidentified
  source 1..7: note = Description of Unknown:NLS sequence
PKKKSRK

SEQ ID NO: 3468 - protein, 7 aa, Caenorhabditis elegans
PKKNKPE

SEQ ID NO: 3469 - protein, 7 aa, unidentified
  source 1..7: note = Description of Unknown:NLS sequence
PKKRAKV

SEQ ID NO: 3470 - protein, 9 aa, unidentified
  source 1..9: note = Description of Unknown:NLS sequence
PKPKKLKVE

SEQ ID NO: 3471 - protein, 7 aa, unidentified
  source 1..7: note = Description of Unknown:NLS sequence
PKRGRGR

SEQ ID NO: 3472 - protein, 9 aa, Mammalian 1 orthobornavirus
PKRRLVDDA

SEQ ID NO: 3473 - protein, 7 aa, unidentified
  source 1..7: note = Description of Unknown:NLS sequence
PKRRRTY

SEQ ID NO: 3474 - protein, 6 aa, unidentified
  source 1..6: note = Description of Unknown:NLS sequence
PLFKRR

SEQ ID NO: 3475 - protein, 7 aa, unidentified
  source 1..7: note = Description of Unknown:NLS sequence
PLRKAKR

SEQ ID NO: 3476 - protein, 9 aa, unidentified
  source 1..9: note = Description of Unknown:NLS sequence
PPAKRKCIF

SEQ ID NO: 3477 - protein, 8 aa, Homo sapiens
PPARRRRL

SEQ ID NO: 3478 - protein, 8 aa, unidentified
  source 1..8: note = Description of Unknown:NLS sequence
PPKKKRKV

SEQ ID NO: 3479 - protein, 10 aa, Mus musculus
PPNKRMKVKH

SEQ ID NO: 3480 - protein, 13 aa, Mammalian 1 orthobornavirus
PPRIYPQLPSAPT

SEQ ID NO: 3481 - protein, 13 aa, unidentified
  source 1..13: note = Description of Unknown:NLS sequence
PQRSPFPKSSVKR

SEQ ID NO: 3482 - protein, 8 aa, Mammalian 1 orthobornavirus
PRPRKVPR

SEQ ID NO: 3483 - protein, 9 aa, unidentified
  source 1..9: note = Description of Unknown:NLS sequence
PRRRVQRKR

SEQ ID NO: 3484 - protein, 7 aa, unidentified
  source 1..7: note = Description of Unknown:NLS sequence
PRRVRLK

SEQ ID NO: 3485 - protein, 7 aa, unidentified
  source 1..7: note = Description of Unknown:NLS sequence
PSRKRPR

SEQ ID NO: 3486 - protein, 8 aa, unidentified
  source 1..8: note = Description of Unknown:NLS sequence
PSSKKRKV

SEQ ID NO: 3487 - protein, 7 aa, Drosophila melanogaster
PTKKRVK

SEQ ID NO: 3488 - protein, 9 aa, unidentified
  source 1..9: note = Description of Unknown:NLS sequence
QRPGPYDRP

SEQ ID NO: 3489 - protein, 18 aa, unidentified
  source 1..18: note = Description of Unknown:NLS sequence
RGKGGKGLGKGGAKRHRK

SEQ ID NO: 3490 - protein, 24 aa, Zea mays
RKAGKGGGGHKTTKKRSAKDEKVP

SEQ ID NO: 3491 - protein, 9 aa, Xenopus laevis
RKIKLKRAK

SEQ ID NO: 3492 - protein, 9 aa, Xenopus laevis
RKIKRKRAK

SEQ ID NO: 3493 - protein, 17 aa, unidentified
  source 1..17: note = Description of Unknown:NLS sequence
RKKEAPGPREELRSRGR

SEQ ID NO: 3494 - protein, 7 aa, unidentified
  source 1..7: note = Description of Unknown:NLS sequence
RKKRKGK

SEQ ID NO: 3495 - protein, 9 aa, unidentified
  source 1..9: note = Description of Unknown:NLS sequence
RKKRRQRRR

SEQ ID NO: 3496 - protein, 25 aa, Homo sapiens
RKKSIPLSIKNLKRKHKRKKNKITR

SEQ ID NO: 3497 - protein, 20 aa, Homo sapiens
RKLVKPKNTKMKTKLRTNPY

SEQ ID NO: 3498 - protein, 16 aa, unidentified
  source 1..16: note = Description of Unknown:NLS sequence
RKRLILSDKGQLDWKK

SEQ ID NO: 3499 - protein, 7 aa, Homo sapiens
RKRLKSK

SEQ ID NO: 3500 - protein, 9 aa, unidentified
  source 1..9: note = Description of Unknown:NLS sequence
RKRRVRDNM

SEQ ID NO: 3501 - protein, 22 aa, Homo sapiens
RKRSPKDKKEKDLDGAGKRRKT

SEQ ID NO: 3502 - protein, 22 aa, Homo sapiens
RKRTPRVDGQTGENDMNKRRRK

SEQ ID NO: 3503 - protein, 10 aa, unidentified
  source 1..10: note = Description of Unknown:NLS sequence
RLPVRRRRRR

SEQ ID NO: 3504 - protein, 10 aa, Feline immunodeficiency virus
RLRFRKPKSK

SEQ ID NO: 3505 - protein, 6 aa, Homo sapiens
RQQRKR

SEQ ID NO: 3506 - protein, 16 aa, Mus musculus
RRDLNSSFETSPKKVK

SEQ ID NO: 3507 - protein, 8 aa, Arabidopsis thaliana
RRDRAKLR

SEQ ID NO: 3508 - protein, 8 aa, unidentified
  source 1..8: note = Description of Unknown:NLS sequence
RRGDGRRR

SEQ ID NO: 3509 - protein, 11 aa, unidentified
  source 1..11: note = Description of Unknown:NLS sequence
RRGRKRKAEKQ

SEQ ID NO: 3510 - protein, 6 aa, unidentified
  source 1..6: note = Description of Unknown:NLS sequence
RRKKRR

SEQ ID NO: 3511 - protein, 19 aa, Mus musculus
RRKRSKSEDMDSVESKRRR

SEQ ID NO: 3512 - protein, 6 aa, unidentified
  source 1..6: note = Description of Unknown:NLS sequence
RRKRSR

SEQ ID NO: 3513 - protein, 14 aa, Homo sapiens
RRPKGKTLQKRKPK

SEQ ID NO: 3514 - protein, 18 aa, unidentified
  source 1..18: note = Description of Unknown:NLS sequence
RRRGFERFGPDNMGRKRK

SEQ ID NO: 3515 - protein, 15 aa, unidentified
  source 1..15: note = Description of Unknown:NLS sequence
RRRGKNKVAAQNCRK

SEQ ID NO: 3516 - protein, 6 aa, unidentified
  source 1..6: note = Description of Unknown:NLS sequence
RRRKRR

SEQ ID NO: 3517 - protein, 14 aa, unidentified
  source 1..14: note = Description of Unknown:NLS sequence
RRRQKQKGGASRRR

SEQ ID NO: 3518 - protein, 13 aa, unidentified
  source 1..13: note = Description of Unknown:NLS sequence
RRRREGPRARRRR

SEQ ID NO: 3519 - protein, 61 aa, unidentified
  source 1..61: note = Description of Unknown:NLS sequence
RRTIRLKLVYDKCDRSCKIQKKNRNKCQYCRFHKCLSVGMSHNAIRFGRMPRSEKAKLKAE

SEQ ID NO: 3520 - protein, 17 aa, unidentified
  source 1..17: note = Description of Unknown:NLS sequence
RRVPQRKEVSRCRKCRK

SEQ ID NO: 3521 - protein, 32 aa, Human mastadenovirus C
RVGGRRQAVECIEDLLNEPGQPLDLSCKRPRP

SEQ ID NO: 3522 - protein, 9 aa, unidentified
  source 1..9: note = Description of Unknown:NLS sequence
RVVKLRIAP

SEQ ID NO: 3523 - protein, 6 aa, Mus musculus
RVVRRR

SEQ ID NO: 3524 - protein, 12 aa, unidentified
  source 1..12: note = Description of Unknown:NLS sequence
SKRKTKISRKTR

SEQ ID NO: 3525 - protein, 16 aa, Squash leaf curl virus
SYVKTVPNRTRTYIKL

SEQ ID NO: 3526 - protein, 12 aa, unidentified
  source 1..12: note = Description of Unknown:NLS sequence
TGKNEAKKRKIA

SEQ ID NO: 3527 - protein, 30 aa, unidentified
  source 1..30: note = Description of Unknown:NLS sequence
TLSPASSPSSVSCPVIPASTDESPGSALNI

SEQ ID NO: 3528 - protein, 12 aa, unidentified
  source 1..12: note = Description of Unknown:NLS sequence
VSKKQRTGKKIH

SEQ ID NO: 3529 - protein, 9 aa, unidentified
  source 1..9: note = Description of Unknown:NLS sequence
SPKKKRKVE

SEQ ID NO: 3530 - protein, 19 aa, unidentified
  source 1..19: note = Description of Unknown:NLS sequence
KRTADGSEFESPKKKRKVE

SEQ ID NO: 3531 - protein, 9 aa, unidentified
  source 1..9: note = Description of Unknown:NLS sequence
PAAKRVKLD

SEQ ID NO: 3532 - protein, 7 aa, unidentified
  source 1..7: note = Description of Unknown:NLS sequence
PKKKRKV

SEQ ID NO: 3533 - protein, 11 aa, unidentified
  source 1..11: note = Description of Unknown:NLS sequence
SPKKKRKVEAS

SEQ ID NO: 3534 - protein, 16 aa, unidentified
  source 1..16: note = Description of Unknown:NLS sequence
MAPKKKRKVGIHRGVP

SEQ ID NO: 3535 - DNA, 24 bp, synthetic construct
  source 1..24: mol_type = other DNA; note = Description of Artificial Sequence: Synthetic oligonucleotide
gttgtagctccctttctcatttcg

SEQ ID NO: 3536 - DNA, 93 bp, synthetic construct
  source 1..93: mol_type = other DNA; note = Description of Artificial Sequence: Synthetic oligonucleotide
cgaaatgagaaccgttgctacaataaggccgtctgaaaagatgtgccgcaacgctctgccccttaaagcttctgctttaaggggcatcgttta

SEQ ID NO: 3537 - DNA, 25 bp, synthetic construct
  source 1..25: mol_type = other DNA; note = Description of Artificial Sequence: Synthetic oligonucleotide
gttgtagctccctttttcatttcgc

SEQ ID NO: 3538 - DNA, 87 bp, synthetic construct
  source 1..87: mol_type = other DNA; note = Description of Artificial Sequence: Synthetic oligonucleotide
gcgaaatgaaaaacgttgttacaataagagatgaatttctcgcaaagctctgcctcttgaaatttcggtttcaagaggcatcttttt

SEQ ID NO: 3539 - DNA, 14 bp, synthetic construct
  source 1..14: mol_type = other DNA; note = Description of Artificial Sequence: Synthetic oligonucleotide
gttttagtactctg

SEQ ID NO: 3540 - DNA, 58 bp, synthetic construct
  source 1..58: mol_type = other DNA; note = Description of Artificial Sequence: Synthetic oligonucleotide
cagaatctactaaaacaaggcaaaatgccgtgtttatctcgtcaacttgttggcgaga

SEQ ID NO: 3541 - DNA, 18 bp, synthetic construct
  source 1..18: mol_type = other DNA; note = Description of Artificial Sequence: Synthetic oligonucleotide
gttttagtactctgtaat

SEQ ID NO: 3542 - DNA, 62 bp, synthetic construct
  source 1..62: mol_type = other DNA; note = Description of Artificial Sequence: Synthetic oligonucleotide
attacagaatctactaaaacaaggcaaaatgccgtgtttatctcgtcaacttgttggcgaga

SEQ ID NO: 3543 - DNA, 63 bp, synthetic construct
  source 1..63: mol_type = other DNA; note = Description of Artificial Sequence: Synthetic oligonucleotide
cagaatctactaaaacaaggcaaaatgccgtgtttatctcgtcaacttgttggcgagattttt

SEQ ID NO: 3544 - DNA, 12 bp, synthetic construct
  source 1..12: mol_type = other DNA; note = Description of Artificial Sequence: Synthetic oligonucleotide
gttttagagcta

SEQ ID NO: 3545 - DNA, 60 bp, synthetic construct
  source 1..60: mol_type = other DNA; note = Description of Artificial Sequence: Synthetic oligonucleotide
tagcaagttaaaataaggctagtccgttatcaacttgaaaaagtggcaccgagtcggtgc

SEQ ID NO: 3546 - DNA, 17 bp, synthetic construct
  source 1..17: mol_type = other DNA; note = Description of Artificial Sequence: Synthetic oligonucleotide
gtttaagagctatgctg

SEQ ID NO: 3547 - DNA, 65 bp, synthetic construct
  source 1..65: mol_type = other DNA; note = Description of Artificial Sequence: Synthetic oligonucleotide
cagcatagcaagtttaaataaggctagtccgttatcaacttgaaaaagtggcaccgagtcggtgc

SEQ ID NO: 3548 - DNA, 14 bp, synthetic construct
  source 1..14: mol_type = other DNA; note = Description of Artificial Sequence: Synthetic oligonucleotide
gtctttgtactctg

SEQ ID NO: 3549 - DNA, 66 bp, synthetic construct
  source 1..66: mol_type = other DNA; note = Description of Artificial Sequence: Synthetic oligonucleotide
cagaagctacaaagataaggcttcatgccgaaatcaacaccctgtcattttatggcagggtgtttt

SEQ ID NO: 3550 - DNA, 16 bp, synthetic construct
  source 1..16: mol_type = other DNA; note = Description of Artificial Sequence: Synthetic oligonucleotide
gctatagttccttact

SEQ ID NO: 3551 - DNA, 127 bp, synthetic construct
  source 1..127: mol_type = other DNA; note = Description of Artificial Sequence: Synthetic polynucleotide
ggtaagttgctatagtaagggcaacagacccgaggcgttggggatcgcctagcccgtgtttacgggctctccccatattcaaaataatgacagacgagcaccttggagcatttatctccgaggtgct

SEQ ID NO: 3552 - RNA, 14 nt, synthetic construct
  source 1..14: mol_type = other RNA; note = Description of Artificial Sequence: Synthetic oligonucleotide
gtcttagtactctg

SEQ ID NO: 3553 - RNA, 65 nt, synthetic construct
  source 1..65: mol_type = other RNA; note = Description of Artificial Sequence: Synthetic oligonucleotide
cagaatctactaagacaaggcaaaatgccgtgtttatctcgtcaacttgttggcgagattttttt

SEQ ID NO: 3554 - RNA, 12 nt, synthetic construct
  source 1..12: mol_type = other RNA; note = Description of Artificial Sequence: Synthetic oligonucleotide
actggggttcag

SEQ ID NO: 3555 - RNA, 76 nt, synthetic construct
  source 1..76: mol_type = other RNA; note = Description of Artificial Sequence: Synthetic oligonucleotide
ctgaacctcagtaagcattggctcgtttccaatgttgattgctccgccggtgctccttatttttaagggcgccggc

SEQ ID NO: 3556 - DNA, 12 bp, synthetic construct
  source 1..12: mol_type = other DNA; note = Description of Artificial Sequence: Synthetic oligonucleotide
gttttagtccct

SEQ ID NO: 3557 - DNA, 63 bp, synthetic construct
  source 1..63: mol_type = other DNA; note = Description of Artificial Sequence: Synthetic oligonucleotide
agggactaaaataaagagtttgcgggactctgcggggttacaatcccctaaaaccgctttttt

SEQ ID NO: 3558 - RNA, 16 nt, synthetic construct
  source 1..16: mol_type = other RNA; note = Description of Artificial Sequence: Synthetic oligonucleotide
gtcatagttcccctga

SEQ ID NO: 3559 - RNA, 98 nt, synthetic construct
  source 1..98: mol_type = other RNA; note = Description of Artificial Sequence: Synthetic oligonucleotide
tcagggttactatgataagggctttctgcctaaggcagactgacccgcggcgttggggatcgcctgtcgcccgcttttggcgggcattccccatcctt

SEQ ID NO: 3560 - protein, 2117 aa, synthetic construct
  source 1..2117: note = Description of Artificial Sequence: Synthetic polypeptide
MKRTADGSEFESPKKKRKVDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSSGGSSGSETPGTSESATPESSGGSSGGSSTLNIEDEYRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGWLTSEGKEIKNKDEILALLKALFLPKRLSIIHCPGHQKGHSAEARGNRMADQAARKAAITETPDTSTLLIENSSPSGGSKRTADGSEFEPKKKRKV

SEQ ID NO: 3561 - protein, 2080 aa, synthetic construct
  source 1..2080: note = Description of Artificial Sequence: Synthetic polypeptide
MAPKKKRKVGIHGVPAADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSSGGSSGSETPGTSESATPESSGGSSGGSSLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLP

SEQ ID NO: 3562 - protein, 2088 aa, synthetic construct
  source 1..2088: note = Description of Artificial Sequence: Synthetic polypeptide
MAPKKKRKVGIHGVPAADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSSGGSSGSETPGTSESATPESSGGSSGGSSLGIEDEYRLHETSTEPDVSLGSTWLSDFPQAWAETGGMGLAVRQAPLIIPLKATSTPVSIQQYPMSHEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPGMGISGQLTWTRLPQGFKNSPTLFNEALHRDLADFRIQHPDLILLQYVDDILLAATSELDCQQGTRALLQTLGDLGYRASAKKAQICQKQVKYLGYLLREGQRWLTEARKETVMGQPVPKTPRQLREFLGKAGFCRLFIPGFAEMAAPLYPLTKPGTLFSWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEEGAPHDCLEILAETHGTRPDLTDQPIPDADHTWYTDGSSFLQEGQRKAGAAVTTETEVIWAGALPAGTSAQRAELIALTQALKMAEGKRLNVYTDSRYAFATAHIHGEIYRRRGWLTSEGREIKNKSEILALLKALFLPKRLSIIHCLGHQKGDSAEARGNRLADQAAREAAIKTPPDTSTLLI

SEQ ID NO: 3563 - protein, 2108 aa, synthetic construct
  source 1..2108: note = Description of Artificial Sequence: Synthetic polypeptide
MAPKKKRKVGIHGVPAADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSSGGSSGSETPGTSESATPESSGGSSGGSSVQEISDSRPMLHIYLNGRRFLGLLDTGADKTCIAGRDWPANWPIHQTESSLQGLGMACGVARSSQPLRWQHEDKSGIIHPFVIPTLPFTLWGRDIMKDIKVRLMTDSPDDSQDLMIGAIESNLFADQISWKSDQPVWLNQWPLKQEKLQALQQLVTEQLQLGHLEESNSPWNTPVFVIKKKSGKWRLLQDLRAVNATMHDMGALQPGLPSPVAVPKGWEIIIIDLQDCFFNIKLHPEDCKRFAFSVPSPNFKRPYQRFQWKVLPQGMKNSPTLCQKFVDKAILTVRDKYQDSYIVHYMDDILLAHPSRSIVDEILTSMIQALNKHGLVVSTEKIQKYDNLKYLGTHIQGDSVSYQKLQIRTDKLRTLNDFQKLLGNINWIRPFLKLTTGELKPLFEILNGDSNPISTRKLTPEACKALQLMNERLSTARVKRLDLSQPWSLCILKTEYTPTACLWQDGVVEWIHLPHISPKVITPYDIFCTQLIIKGRHRSKELFSKDPDYIVVPYTKVQFDLLLQEKEDWPISLLGFLGEVHFHLPKDPLLTFTLQTAIIFPHMTSTTPLEKGIVIFTDGSANGRSVTYIQGREPIIKENTQNTAQQAEIVAVITAFEEVSQPFNLYTDSKYVTGLFPEIETATLSPRTKIYTELKHLQRLIHKRQEKFYIGHIRGHTGLPGPLAQGNAYADSLTRILTA

SEQ ID NO: 3564 - protein, 2002 aa, synthetic construct
  source 1..2002: note = Description of Artificial Sequence: Synthetic polypeptide
MAPKKKRKVGIHGVPAADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSSGGSSGSETPGTSESATPESSGGSSGGSSTAAIDILAPQQCAEPITWKSDEPVWVDQWPLTNDKLAAAQQLVQEQLEAGHITESSSPWNTPIFVIKKKSGKWRLLQDLRAVNATMVLMGALQPGLPSPVAIPQGYLKIIIDLKDCFFSIPLHPSDQKRFAFSLPSTNFKEPMQRFQWKVLPQGMANSPTLCQKYVATAIHKVRHAWKQMYIIHYMDDILIAGKDGQQVLQCFDQLKQELTAAGLHIAPEKVQLQDPYTYLGFELNGPKITNQKAVIRKDKLQTLNDFQKLLGDINWLRPYLKLTTGDLKPLFDTLKGDSDPNSHRSLSKEALASLEKVETAIAEQFVTHINYSLPLIFLIFNTALTPTGLFWQDNPIMWIHLPASPKKVLLPYYDAIADLIILGRDHSKKYFGIEPSTIIQPYSKSQIDWLMQNTEMWPIACASFVGILDNHYPPNKLIQFCKLHTFVFPQIISKTPLNNALLVFTDGSSTGMAAYTLTDTTIKFQTNLNSAQLVELQALIAVLSAFPNQPLNIYTDSAYLAHSIPLLETVAQIKHISETAKLFLQCQQLIYNRSIPFYIGHVRAHSGLPGPIAQGNQRADLATKIVASNINTN

SEQ ID NO: 3565 - RNA, 6507 nt, synthetic construct
  source 1..6507: mol_type = other RNA; note = Description of Artificial Sequence: Synthetic polynucleotide
aggaaataagagagaaaagaagagtaagaagaaatataagagccaccatgaaacggacagccgacggaagcgagttcgagtcaccaaagaagaagcggaaagtcgacaagaagtacagcatcggcctggacatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggaccatatcgtgcctcagagctttctgaaggacgactccatcgacaacaaggtgctgaccagaagcgacaaggcccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggtgactctggaggatctagcggaggatcctctggcagcgagacaccaggaacaagcgagtcagcaacaccagagagcagtggcggcagcagcggcggcagcagcaccctaaatatagaagatgagtatcggctacatgagacctcaaaagagccagatgtttctctagggtccacatggctgtctgattttcctcaggcctgggcggaaaccgggggcatgggactggcagttcgccaagctcctctgatcatacctctgaaagcaacctctacccccgtgtccataaaacaataccccatgtcacaagaagccagactggggatcaagccccacatacagagactgttggaccagggaatactggtaccctgccagtccccctggaacacgcccctgctacccgttaagaaaccagggactaatgattataggcctgtccaggatctgagagaagtcaacaagcgggtggaagacatccaccccaccgtgcccaacccttacaacctcttgagcgggctcccaccgtcccaccagtggtacactgtgcttgatttaaaggatgcctttttctgcctgagactccaccccaccagtcagcctctcttcgcctttgagtggagagatccagagatgggaatctcaggacaattgacctggaccagactcccacagggtttcaaaaacagtcccaccctgtttaatgaggcactgcacagagacctagcagacttccggatccagcacccagacttgatcctgctacagtacgtggatgacttactgctggccgccacttctgagctagactgccaacaaggtactcgggccctgttacaaaccctagggaacctcgggtatcgggcctcggccaagaaagcccaaatttgccagaaacaggtcaagtatctggggtatcttctaaaagagggtcagagatggctgactgaggccagaaaagagactgtgatggggcagcctactccgaagacccctcgacaactaagggagttcctagggaaggcaggcttctgtcgcctcttcatccctgggtttgcagaaatggcagcccccctgtaccctctcaccaaaccggggactctgtttaattggggcccagaccaacaaaaggcctatcaagaaatcaagcaagctcttctaactgccccagccctggggttgccagatttgactaagccctttgaactctttgtcgacgagaagcagggctacgccaaaggtgtcctaacgcaaaaactgggaccttggcgtcggccggtggcctacctgtccaaaaagctagacccagtagcagctgggtggcccccttgcctacggatggtagcagccattgccgtactgacaaaggatgcaggcaagctaaccatgggacagccactagtcattctggccccccatgcagtagaggcactagtcaaacaaccccccgaccgctggctttccaacgcccggatgactcactatcaggccttgcttttggacacggaccgggtccagttcggaccggtggtagccctgaacccggctacgctgctcccactgcctgaggaagggctgcaacacaactgccttgatatcctggccgaagcccacggaacccgacccgacctaacggaccagccgctcccagacgccgaccacacctggtacacggatggaagcagtctcttacaagagggacagcgtaaggcgggagctgcggtgaccaccgagaccgaggtaatctgggctaaagccctgccagccgggacatccgctcagcgggctgaactgatagcactcacccaggccctaaagatggcagaaggtaagaagctaaatgtttatactgatagccgttatgcttttgctactgcccatatccatggagaaatatacagaaggcgtgggtggctcacatcagaaggcaaagagatcaaaaataaagacgagatcttggccctactaaaagccctctttctgcccaaaagacttagcataatccattgtccaggacatcaaaagggacacagcgccgaggctagaggcaaccggatggctgaccaagcggcccgaaaggcagccatcacagagactccagacacctctaccctcctcatagaaaattcatcaccctctggcggctcaaaaagaaccgccgacggcagcgaattcgagcccaagaagaagaggaaagtctgattaattaagctgccttctgcggggcttgccttctggccatgcccttcttctctcccttgcacctgtacctcttggtctttgaataaagcctgagtaggaagtctag

SEQ ID NO: 3566 - RNA, 6396 nt, synthetic construct
  source 1..6396: mol_type = other RNA; note = Description of Artificial Sequence: Synthetic polynucleotide
aggaaataagagagaaaagaagagtaagaagaaatataagagccaccatggctcccaaaaagaaaaggaaggtgggcattcacggcgtgcctgcggccgacaaaaagtacagcatcggccttgatatcggcaccaatagcgtgggctgggccgttatcacagacgaatacaaggtacccagcaagaagttcaaggtgctggggaatacagacaggcactctatcaagaaaaaccttatcggggctctgctgtttgactcaggcgagaccgccgaggccaccaggttgaagaggaccgcaaggcgaaggtacacccggaggaagaacaggatctgctatctgcaggagatcttcagcaacgagatggccaaggtggacgacagcttcttccacaggctggaggagagcttccttgtcgaggaggataagaagcacgaacgacaccccatcttcggcaacatagtcgacgaggtcgcttatcacgagaagtaccccaccatctaccacctgcgaaagaaattggtggatagcaccgataaagccgacttgcgacttatctacttggctctggcgcacatgattaagttcaggggccacttcctgatcgagggcgaccttaaccccgacaacagtgacgtagacaaattgttcatccagcttgtacagacctataaccagctgttcgaggaaaaccctattaacgccagcggggtggatgcgaaggccatacttagcgccaggctgagcaaaagcaggcgcttggagaacctgatagcccagctgcccggtgaaaagaagaacggcctcttcggtaatctgattgccctgagcctgggcctgacccccaacttcaagagcaacttcgacctggcagaagatgccaagctgcagttgagtaaggacacctatgacgacgacttggacaatctgctcgcccaaatcggcgaccagtacgctgacctgttcctcgccgccaagaacctttctgacgcaatcctgcttagcgatatccttagggtgaacacagagatcaccaaggcccccctgagcgccagcatgatcaagaggtacgacgagcaccatcaggacctgacccttctgaaggccctggtgaggcagcaactgcccgagaagtacaaggagatctttttcgaccagagcaagaacggctacgccggctacatcgacggcggagccagccaagaggagttctacaagttcatcaagcccatcctggagaagatggatggcaccgaggagctgctggtgaagctgaacagggaagatttgctccggaagcagaggacctttgacaacggtagcatcccccaccagatccacctgggcgagctgcacgcaatactgaggcgacaggaggatttctaccccttcctcaaggacaatagggagaaaatcgaaaagattctgaccttcaggatcccctactacgtgggccctcttgccaggggcaacagccgattcgcttggatgacaagaaagagcgaggagaccatcaccccctggaacttcgaggaagtggtggacaaaggagcaagcgcgcagtctttcatcgaacggatgaccaatttcgacaaaaacctgcctaacgagaaggtgctgcccaagcacagcctgctttacgagtacttcaccgtgtacaacgagctcaccaaggtgaaatatgtgaccgagggcatgcgaaaacccgctttcctgagcggcgagcagaagaaggccatcgtggacctgctgttcaagaccaacaggaaggtgaccgtgaagcagctgaaggaggactacttcaagaagatcgagtgctttgatagcgtggaaataagcggcgtggaggacaggttcaacgccagcctgggcacctaccacgacttgttgaagataatcaaagacaaggatttcctggataatgaggagaacgaggatatactcgaggacatcgtgctgactttgaccctgtttgaggaccgagagatgattgaagaaaggctcaaaacctacgcccacctgttcgacgacaaagtgatgaaacaactgaagagacgaagatacaccggctggggcagactgtccaggaagctcatcaacggcattagggacaagcagagcggcaagaccatcctggatttcctgaagtccgacggcttcgccaaccgaaacttcatgcagctgattcacgatgacagcttgaccttcaaggaggacatccagaaggcccaggttagcggccagggcgactccctgcacgaacatattgcaaacctggcaggctcccctgcgatcaagaagggcatactgcagaccgttaaggttgtggacgaattggtcaaggtcatgggcaggcacaagcccgaaaacatagttatagagatggccagagagaaccagaccacccaaaagggccagaagaacagccgggagcgcatgaaaaggatcgaggagggtatcaaggaactcggaagccagatcctcaaagagcaccccgtggagaatacccagctccagaacgagaagctgtacctgtactacctgcagaacggcagggacatgtacgttgaccaggagttggacatcaacaggctttcagactatgacgtggatcacatagtgccccagagctttcttaaagacgatagcatcgacaacaaggtcctgacccgctccgacaaagccaggggcaaaagcgacaacgtgccaagcgaagaggtggttaaaaagatgaagaactactggaggcaactgctcaacgcgaaattgatcacccagagaaagttcgataacctgaccaaggccgagaggggcggactctccgaacttgacaaagcgggcttcataaagaggcagctggtcgagacccgacagatcacgaagcacgtggcccaaatcctcgacagcagaatgaataccaagtacgatgagaatgacaaactcatcagggaagtgaaagtgattaccctgaagagcaagttggtgtccgactttcgcaaagatttccagttctacaaggtgagggagatcaacaactaccaccatgcccacgacgcatacctgaacgccgtggtcggcaccgccctgattaagaagtatccaaagctggagtccgaatttgtctacggcgactacaaagtttacgatgtgaggaagatgatcgctaagagcgaacaggagatcggcaaggccaccgctaagtatttcttctacagcaacatcatgaactttttcaagaccgagatcacacttgccaacggcgaaatcaggaagaggccgcttatcgagaccaacggtgagaccggcgagatcgtgtgggacaagggcagggacttcgccaccgtgaggaaagtcctgagcatgccccaggtgaatattgtgaaaaaaactgaggtgcagacaggcggctttagcaaggaatccatcctgcccaagaggaacagcgacaagctgatcgcccggaagaaggactgggaccctaagaagtatggaggcttcgacagccccaccgtagcctacagcgtgctggtggtcgcgaaggtagagaaggggaagagcaagaaactgaagagcgtgaaggagctgctcggcataaccatcatggagaggtccagctttgagaagaaccccattgactttttggaagccaagggctacaaagaggtcaaaaaggacctgatcatcaaactccccaagtactccctgtttgaattggagaacggcagaaagaggatgctggcgagcgctggggaactgcaaaagggcaacgaactggcgctgcccagcaagtacgtgaattttctgtacctggcgtcccactacgaaaagctgaaaggcagccccgaggacaacgagcagaagcagctgttcgtggagcagcacaagcattacctggacgagataatcgagcaaatcagcgagttcagcaagagggtgattctggccgacgcgaacctggataaggtcctcagcgcctacaacaagcaccgagacaaacccatcagggagcaggccgagaatatcatacacctgttcaccctgacaaatctgggcgcacctgcggcattcaaatacttcgataccaccatcgacaggaaaaggtacactagcactaaggaggtgctggatgccaccttgatccaccagtccattaccggcctgtatgagaccaggatcgacctgagccagcttggaggcgactctggaggatctagcggaggatcctctggcagcgagacaccaggaacaagcgagtcagcaacaccagagagcagtggcggcagcagcggcggcagcagcctggacgacgagtacagactgtatagccctctggtgaagccagatcagaacattcagttctggctggaacagtttccacaggcctgggccgaaacagccggaatgggcctggccaagcaggtgcctcctcaggtgatccagctgaaggccagcgccacacctgtgtccgtgcggcagtaccctctgtccaaggaggctcaggagggcatcagacctcacgtccagcggctgatccagcaggggatcctggtgcccgtgcaaagcccttggaacacccctcttctgcccgtgagaaaacccggcacaaacgactaccggcctgtgcaggacctgagagaagtgaacaagcgggtgcaggacatccaccccacagtgccaaatccttacaacctgctttgtgccctgcccccccagcgcagctggtacaccgttctggacctgaaagatgcctttttctgtctgagacttcatcctacaagccagcccctgttcgccttcgagtggcgggatcctggcaccggccggacaggccagctgacatggaccagactgcctcagggcttcaagaacagccctaccatcttcaacgaggccctgcacagagaccttgccaacttcagaatccaacacccacaggtgaccctgctccagtacgtggatgacctgctgctggccggcgccacaaaacaagattgcctggaaggcaccaaggcccttctgctggagctgagcgacctgggatatcgggcctctgctaagaaagctcagatctgcaggagagaggtgacctacctgggctactctctgagagatggccaaagatggctgaccgaggccagaaagaaaaccgtggtgcaaatccccgctcctacaacagccaagcaggttagagagttcctgggaaaggctggattttgcagactgttcatcccaggctttgccaccctggccgcccctctgtaccccctgaccaaacctaagggcgagttcagctgggccccagagcaccagaaggcattcgacgcgatcaagaaggctctgctgtctgcccctgccctggctctgcccgacgtgacaaagcccttcaccctgtacgtggacgaacggaagggcgtggctagaggcgttctgacccagaccctgggtccttggagaaggcctgtggcctacctcagtaagaagctggatcctgtggcctctggctggcctgtgtgcctgaaggccatcgccgccgtggccattctggtcaaggatgccgataagctgaccctaggccagaatatcaccgtgatcgcccctcacgccctcgagaacatcgtgcggcagcctcccgacagatggatgaccaacgccagaatgacccactaccagagcctgttgctgaccgagagagtgaccttcgcccctccagctgccctgaatcccgccactctgctgcccgaggaaaccgacgagcctgtgacccacgactgccaccagctgctgatcgaggaaaccggcgtcagaaaggacctgacagatatccctctgaccggagaggtgctgacatggttcaccgacggcagcagctacgtcgtggaaggcaagcggatggccggcgccgctgtggtcgacggcacaagaaccatctgggcttccagcctgcctgagggcaccagcgcccagaaggccgagctgatggccctcacacaggccctgcggctggctgagggcaaaagcatcaacatctatacagacagccgttacgccttcgccacagcgcacgtgcacggcgccatctacaagcagagaggatggctgacctctgccggaagagaaatcaagaacaaggaagaaatcctgagcctgctggaagccctgcatctcccaaagagactggccatcatccactgccccggccaccagaaggccaaagaccctatcagcagaggcaaccagatggccgaccgggtggccaagcaagccgcccaaggcgtgaatctgctgccttagttaattaagctgccttctgcggggcttgccttctggccatgcccttcttctctcccttgcacctgtacctcttggtctttgaataaagcctgagtaggaagtctag

SEQ ID NO: 3567 - RNA, 21 nt, Homo sapiens
  source 1..21: mol_type = unassigned RNA
cataaagtagaaagcactact

SEQ ID NO: 3568 - RNA, 24 nt, Homo sapiens
  source 1..24: mol_type = unassigned RNA
tttggcaatggtagaactcacact

SEQ ID NO: 3569 - RNA, 21 nt, Homo sapiens
  source 1..21: mol_type = unassigned RNA
tggttctagacttgccaacta

SEQ ID NO: 3570 - RNA, 22 nt, Homo sapiens
  source 1..22: mol_type = unassigned RNA
tatggcactggtagaattcact

SEQ ID NO: 3571 - RNA, 22 nt, Homo sapiens
  source 1..22: mol_type = unassigned RNA
gtgaattaccgaagggccataa

SEQ ID NO: 3572 - RNA, 22 nt, Homo sapiens
  source 1..22: mol_type = unassigned RNA
tggagtgtgacaatggtgtttg

SEQ ID NO: 3573 - RNA, 22 nt, Homo sapiens
  source 1..22: mol_type = unassigned RNA
aacgccattatcacactaaata

SEQ ID NO: 3574 - DNA, 20 bp, synthetic construct
  source 1..20: mol_type = other DNA; note = Description of Artificial Sequence: Synthetic oligonucleotide
ggcccagactgagcacgtga

SEQ ID NO: 3575 - DNA, 76 bp, synthetic construct
  source 1..76: mol_type = other DNA; note = Description of Artificial Sequence: Synthetic oligonucleotide
gttttagagctagaaatagcaagttaaaataaggctagtccgttatcaacttgaaaaagtggcaccgagtcggtgc

SEQ ID NO: 3576 - DNA, 13 bp, synthetic construct
  source 1..13: mol_type = other DNA; note = Description of Artificial Sequence: Synthetic oligonucleotide
tctgccatcaaag

SEQ ID NO: 3577 - DNA, 117 bp, synthetic construct
  source 1..117: mol_type = other DNA; note = Description of Artificial Sequence: Synthetic polynucleotide
ggcccagactgagcacgtgagttttagagctagaaatagcaagttaaaataaggctagtccgttatcaacttgaaaaagtggcaccgagtcggtgctctgccatcaaagcgtgctca

SEQ ID NO: 3578 - DNA, 13 bp, synthetic construct
  source 1..13: mol_type = other DNA; note = Description of Artificial Sequence: Synthetic oligonucleotide
cgtgctcagtctg

SEQ ID NO: 3579 - DNA, 122 bp, synthetic construct
  source 1..122: mol_type = other DNA; note = Description of Artificial Sequence: Synthetic polynucleotide
ggcccagactgagcacgtgagttttagagctagaaatagcaagttaaaataaggctagtccgttatcaacttgaaaaagtggcaccgagtcggtgctctgccatcaaagcgtgctcagtctg

SEQ ID NO: 3580 - DNA, 17 bp, synthetic construct
  source 1..17: mol_type = other DNA; note = Description of Artificial Sequence: Synthetic oligonucleotide
cgtgctcagtctgggcc

SEQ ID NO: 3581 - DNA, 126 bp, synthetic construct
  source 1..126: mol_type = other DNA; note = Description of Artificial Sequence: Synthetic polynucleotide
ggcccagactgagcacgtgagttttagagctagaaatagcaagttaaaataaggctagtccgttatcaacttgaaaaagtggcaccgagtcggtgctctgccatcaaagcgtgctcagtctgggcc

SEQ ID NO: 3582 - DNA, 21 bp, synthetic construct
  source 1..21: mol_type = other DNA; note = Description of Artificial Sequence: Synthetic oligonucleotide
gcatggtgcacctgactcctg

SEQ ID NO: 3583 - DNA, 14 bp, synthetic construct
  source 1..14: mol_type = other DNA; note = Description of Artificial Sequence: Synthetic oligonucleotide
agacttctccacag

SEQ ID NO: 3584 - DNA, 13 bp, synthetic construct
  source 1..13: mol_type = other DNA; note = Description of Artificial Sequence: Synthetic oligonucleotide
gagtcaggtgcac

SEQ ID NO: 3585 - DNA, 124 bp, synthetic construct
  source 1..124: mol_type = other DNA; note = Description of Artificial Sequence: Synthetic polynucleotide
gcatggtgcacctgactcctggttttagagctagaaatagcaagttaaaataaggctagtccgttatcaacttgaaaaagtggcaccgagtcggtgcagacttctccacaggagtcaggtgcac

SEQ ID NO: 3586 - DNA, 21 bp, synthetic construct
  source 1..21: mol_type = other DNA; note = Description of Artificial Sequence: Synthetic oligonucleotide
gccttgataccaacctgccca

SEQ ID NO: 3587 - DNA, 20 bp, synthetic construct
  source 1..20: mol_type = other DNA; note = Description of Artificial Sequence: Synthetic oligonucleotide
gtcccctccaccccacagtg

SEQ ID NO: 3588 - RNA, 100 nt, synthetic construct
  source 1..100: mol_type = other RNA; note = Description of Artificial Sequence: Synthetic polynucleotide
  modified_base 1: mod_base = OTHER; note = 2'O-methyl guanosine phosphorothioate
  modified_base 2: mod_base = OTHER; note = 2'O-methyl cytidine phosphorothioate
  modified_base 3: mod_base = OTHER; note = 2'O-methyl adenosine phosphorothioate
  modified_base 97: mod_base = OTHER; note = 2'O-methyl uridine phosphorothioate
  modified_base 98: mod_base = OTHER; note = 2'O-methyl uridine phosphorothioate
  modified_base 99: mod_base = OTHER; note = 2'O-methyl uridine phosphorothioate
gcagaaatagactaattgcagttttagagctagaaatagcaagttaaaataaggctagtccgttatcaacttgaaaaagtggcaccgagtcggtgctttt

SEQ ID NO: 3589 - DNA, 126 bp, synthetic construct
  source 1..126: mol_type = other DNA; note = Description of Artificial Sequence: Synthetic polynucleotide
ggcccagactgagcacgtgagttttagagctagaaatagcaagttaaaataaggctagtccgttatcaacttgaaaaagtggcaccgagtcggtgctctgccatcaaagcgtgctcagtctgtttt

SEQ ID NO: 3590 - RNA, 126 nt, synthetic construct
  source 1..126: mol_type = other RNA; note = Description of Artificial Sequence: Synthetic polynucleotide
  modified_base 1: mod_base = OTHER; note = 2'O-methyl guanosine phosphorothioate
  modified_base 2: mod_base = OTHER; note = 2'O-methyl guanosine phosphorothioate
  modified_base 3: mod_base = OTHER; note = 2'O-methyl cytidine phosphorothioate
  modified_base 123: mod_base = OTHER; note = uridine phosphorothioate
  modified_base 124: mod_base = OTHER; note = 2'O-methyl uridine phosphorothioate
  modified_base 125: mod_base = OTHER; note = 2'O-methyl uridine phosphorothioate
  modified_base 126: mod_base = OTHER; note = 2'O-methyl uridine
ggcccagactgagcacgtgagttttagagctagaaatagcaagttaaaataaggctagtccgttatcaacttgaaaaagtggcaccgagtcggtgctctgccatcaaagcgtgctcagtctgtttt

SEQ ID NO: 3591 - DNA, 20 bp, synthetic construct
  source 1..20: mol_type = other DNA; note = Description of Artificial Sequence: Synthetic oligonucleotide
tctgccatcacatgtagttg

SEQ ID NO: 3592 - DNA, 133 bp, synthetic construct
  source 1..133: mol_type = other DNA; note = Description of Artificial Sequence: Synthetic polynucleotide
ggcccagactgagcacgtgagttttagagctagaaatagcaagttaaaataaggctagtccgttatcaacttgaaaaagtggcaccgagtcggtgctctgccatcacatgtagttgcgtgctcagtctgtttt

SEQ ID NO: 3593 - RNA, 133 nt, synthetic construct
  source 1..133: mol_type = other RNA; note = Description of Artificial Sequence: Synthetic polynucleotide
  modified_base 1: mod_base = OTHER; note = 2'O-methyl guanosine phosphorothioate
  modified_base 2: mod_base = OTHER; note = 2'O-methyl guanosine phosphorothioate
  modified_base 3: mod_base = OTHER; note = 2'O-methyl cytidine phosphorothioate
  modified_base 130: mod_base = OTHER; note = uridine phosphorothioate
  modified_base 131: mod_base = OTHER; note = 2'O-methyl uridine phosphorothioate
  modified_base 132: mod_base = OTHER; note = 2'O-methyl uridine phosphorothioate
  modified_base 133: mod_base = OTHER; note = 2'O-methyl uridine
ggcccagactgagcacgtgagttttagagctagaaatagcaagttaaaataaggctagtccgttatcaacttgaaaaagtggcaccgagtcggtgctctgccatcacatgtagttgcgtgctcagtctgtttt

SEQ ID NO: 3594 - DNA, 30 bp, synthetic construct
  source 1..30: mol_type = other DNA; note = Description of Artificial Sequence: Synthetic oligonucleotide
tctgccatcacatgtagttgaggtcaatga

SEQ ID NO: 3595 - DNA, 143 bp, synthetic construct
  source 1..143: mol_type = other DNA; note = Description of Artificial Sequence: Synthetic polynucleotide
ggcccagactgagcacgtgagttttagagctagaaatagcaagttaaaataaggctagtccgttatcaacttgaaaaagtggcaccgagtcggtgctctgccatcacatgtagttgaggtcaatgacgtgctcagtctgtttt

SEQ ID NO: 3596 - RNA, 143 nt, synthetic construct
  source 1..143: mol_type = other RNA; note = Description of Artificial Sequence: Synthetic polynucleotide
  modified_base 1: mod_base = OTHER; note = 2'O-methyl guanosine phosphorothioate
  modified_base 2: mod_base = OTHER; note = 2'O-methyl guanosine phosphorothioate
  modified_base 3: mod_base = OTHER; note = 2'O-methyl cytidine phosphorothioate
  modified_base 140: mod_base = OTHER; note = uridine phosphorothioate
  modified_base 141: mod_base = OTHER; note = 2'O-methyl uridine phosphorothioate
  modified_base 142: mod_base = OTHER; note = 2'O-methyl uridine phosphorothioate
  modified_base 143: mod_base = OTHER; note = 2'O-methyl uridine
ggcccagactgagcacgtgagttttagagctagaaatagcaagttaaaataaggctagtccgttatcaacttgaaaaagtggcaccgagtcggtgctctgccatcacatgtagttgaggtcaatgacgtgctcagtctgtttt

SEQ ID NO: 3597 - DNA, 33 bp, synthetic construct
  source 1..33: mol_type = other DNA; note = Description of Artificial Sequence: Synthetic oligonucleotide
ggaagcagggcttcctttcctctgccatcaaag

SEQ ID NO: 3598 - DNA, 146 bp, synthetic construct
  source 1..146: mol_type = other DNA; note = Description of Artificial Sequence: Synthetic polynucleotide
ggcccagactgagcacgtgagttttagagctagaaatagcaagttaaaataaggctagtccgttatcaacttgaaaaagtggcaccgagtcggtgcggaagcagggcttcctttcctctgccatcaaagcgtgctcagtctgtttt

SEQ ID NO: 3599 - RNA, 146 nt, synthetic construct
  source 1..146: mol_type = other RNA; note = Description of Artificial Sequence: Synthetic polynucleotide
  modified_base 1: mod_base = OTHER; note = 2'O-methyl guanosine phosphorothioate
  modified_base 2: mod_base = OTHER; note = 2'O-methyl guanosine phosphorothioate
  modified_base 3: mod_base = OTHER; note = 2'O-methyl cytidine phosphorothioate
  modified_base 143: mod_base = OTHER; note = uridine phosphorothioate
  modified_base 144: mod_base = OTHER; note = 2'O-methyl uridine phosphorothioate
  modified_base 145: mod_base = OTHER; note = 2'O-methyl uridine phosphorothioate
  modified_base 146: mod_base = OTHER; note = 2'O-methyl uridine
ggcccagactgagcacgtgagttttagagctagaaatagcaagttaaaataaggctagtccgttatcaacttgaaaaagtggcaccgagtcggtgcggaagcagggcttcctttcctctgccatcaaagcgtgctcagtctgtttt

SEQ ID NO: 3600 - DNA, 40 bp, synthetic construct
  source 1..40: mol_type = other DNA; note = Description of Artificial Sequence: Synthetic oligonucleotide
ggaagcagggcttcctttcctctgccatcacatgtagttg

SEQ ID NO: 3601 - DNA, 153 bp, synthetic construct
  source 1..153: mol_type = other DNA; note = Description of Artificial Sequence: Synthetic polynucleotide
ggcccagactgagcacgtgagttttagagctagaaatagcaagttaaaataaggctagtccgttatcaacttgaaaaagtggcaccgagtcggtgcggaagcagggcttcctttcctctgccatcacatgtagttgcgtgctcagtctgtttt

SEQ ID NO: 3602 - RNA, 153 nt, synthetic construct
  source 1..153: mol_type = other RNA; note = Description of Artificial Sequence: Synthetic polynucleotide
  modified_base 1: mod_base = OTHER; note = 2'O-methyl guanosine phosphorothioate
  modified_base 2: mod_base = OTHER; note = 2'O-methyl guanosine phosphorothioate
  modified_base 3: mod_base = OTHER; note = 2'O-methyl cytidine phosphorothioate
  modified_base 150: mod_base = OTHER; note = uridine phosphorothioate
  modified_base 151: mod_base = OTHER; note = 2'O-methyl uridine phosphorothioate
  modified_base 152: mod_base = OTHER; note = 2'O-methyl uridine phosphorothioate
  modified_base 153: mod_base = OTHER; note = 2'O-methyl uridine
ggcccagactgagcacgtgagttttagagctagaaatagcaagttaaaataaggctagtccgttatcaacttgaaaaagtggcaccgagtcggtgcggaagcagggcttcctttcctctgccatcacatgtagttgcgtgctcagtctgtttt

SEQ ID NO: 3603 - DNA, 50 bp, synthetic construct
  source 1..50: mol_type = other DNA; note = Description of Artificial Sequence: Synthetic oligonucleotide
ggaagcagggcttcctttcctctgccatcacatgtagttgaggtcaatga

SEQ ID NO: 3604 - DNA, 163 bp, synthetic construct
  source 1..163: mol_type = other DNA; note = Description of Artificial Sequence: Synthetic polynucleotide
ggcccagactgagcacgtgagttttagagctagaaatagcaagttaaaataaggctagtccgttatcaacttgaaaaagtggcaccgagtcggtgcggaagcagggcttcctttcctctgccatcacatgtagttgaggtcaatgacgtgctcagtctgtttt

SEQ ID NO: 3605 - RNA, 163 nt, synthetic construct
  source 1..163: mol_type = other RNA; note = Description of Artificial Sequence: Synthetic polynucleotide
  modified_base 1: mod_base = OTHER; note = 2'O-methyl guanosine phosphorothioate
  modified_base 2: mod_base = OTHER; note = 2'O-methyl guanosine phosphorothioate
  modified_base 3: mod_base = OTHER; note = 2'O-methyl cytidine phosphorothioate
  modified_base 160: mod_base = OTHER; note = uridine phosphorothioate
  modified_base 161: mod_base = OTHER; note = 2'O-methyl uridine phosphorothioate
  modified_base 162: mod_base = OTHER; note = 2'O-methyl uridine phosphorothioate
  modified_base 163: mod_base = OTHER; note = 2'O-methyl uridine
ggcccagactgagcacgtgagttttagagctagaaatagcaagttaaaataaggctagtccgttatcaacttgaaaaagtggcaccgagtcggtgcggaagcagggcttcctttcctctgccatcacatgtagttgaggtcaatgacgtgctcagtctgtttt

SEQ ID NO: 3606 - DNA, 47 bp, synthetic construct
  source 1..47: mol_type = other DNA; note = Description of Artificial Sequence: Synthetic oligonucleotide
aggaaataagagagaaaagaagagtaagaagaaatataagagccacc

SEQ ID NO: 3607 - DNA, 101 bp, synthetic construct
  source 1..101: mol_type = other DNA; note = Description of Artificial Sequence: Synthetic polynucleotide
gctggagcctcggtggccatgcttcttgccccttgggcctccccccagcccctcctccccttcctgcacccgtacccccgtggtctttgaataaagtctga

SEQ ID NO: 3608 - DNA, 47 bp, synthetic construct
  source 1..47: mol_type = other DNA; note = Description of Artificial Sequence: Synthetic oligonucleotide
gggaaataagagagaaaagaagagtaagaagaaatataagagccacc

SEQ ID NO: 3609 - DNA, 97 bp, synthetic construct
  source 1..97: mol_type = other DNA; note = Description of Artificial Sequence: Synthetic oligonucleotide
gctgccttctgcggggcttgccttctggccatgcccttcttctctcccttgcacctgtacctcttggtctttgaataaagcctgagtaggaagtcta

SEQ ID NO: 3610 - protein, 31 aa, synthetic construct
  source 1..31: note = Description of Artificial Sequence: Synthetic polypeptide
WTVLPQGFKNSPTLFDEALARDLADFRIQHP

SEQ ID NO: 3611 - protein, 31 aa, Gammaretrovirus sp.
WTRLPQGFKNSPTLFDEALHRDLADFRIQHP

SEQ ID NO: 3612 - protein, 31 aa, Gammaretrovirus sp.
WTRLPQGFKNSPTLFDEALNRDLQGFRLDHP

SEQ ID NO: 3613 - protein, 31 aa, Gammaretrovirus sp.
WTRLPQGFKNSPTIFDEALHRDLANFRIQHP

SEQ ID NO: 3614 - protein, 31 aa, Epsilonretrovirus sp.
WTVLPQGFIHSPTLFSQALYQSLHKIKFKIS

SEQ ID NO: 3615 - protein, 31 aa, Deltaretrovirus sp.
WRVLPQGFINSPALFERALQEPLRQVSAAFS

SEQ ID NO: 3616 - protein, 31 aa, Deltaretrovirus sp.
WRVLPQGFKNSPTLFEMQLAHILQPIRQAFP

SEQ ID NO: 3617 - protein, 31 aa, Deltaretrovirus sp.
WKVLPQGFKNSPTLFEMQLAHILQPIRQAFP

SEQ ID NO: 3618 - protein, 31 aa, Deltaretrovirus sp.
WTVLPQGFKNSPTLFEQQLAAVLNPMRKMFP

SEQ ID NO: 3619 - protein, 31 aa, Betaretrovirus sp.
WKVLPQGMANSPTLCQKYVATAIHKVRHAWK

SEQ ID NO: 3620 - protein, 31 aa, Betaretrovirus sp.
WKVLPQGMKNSPTLCQKFVDKAILTVRDKYQ

SEQ ID NO: 3621 - protein, 31 aa, Betaretrovirus sp.
WKVLPQGMANSPTLCQKFVAAAIAPVRAQWP

SEQ ID NO: 3622 - protein, 27 aa, Spumavirus sp.
WTRLPQGFLNSPALFTADVVDLLKEIP

SEQ ID NO: 3623 - protein, 29 aa, synthetic construct
  source 1..29: note = Description of Artificial Sequence: Synthetic peptide
  VARIANT 10: note = A, Q, K, H, or V
  VARIANT 19: note = G, K, D, I, H, Y, or A
  VARIANT 23: note = L, P, I, Q, C, H, T, V, F, Y, or absent
  VARIANT 27: note = G, A, D, S, N, or T
WIPGFAELLXPLYPLLKGXTDPXISLXPE

SEQ ID NO: 3624 - protein, 27 aa, Gammaretrovirus sp.
WIPGFAEMAAPLYPLTKTGTLFNWGPD

SEQ ID NO: 3625 - protein, 28 aa, Gammaretrovirus sp.
WIPGFAELAQPLYAATRGGNDPLVWGEK

SEQ ID NO: 3626 - protein, 27 aa, Gammaretrovirus sp.
WIPGFATLAAPLYPLTKEKGEFSWAPE

SEQ ID NO: 3627 - protein, 27 aa, Gammaretrovirus sp.
WIPGFAEMAAPLYPLTKTGTLFSWGPD

SEQ ID NO: 3628 - protein, 29 aa, Epsilonretrovirus sp.
WIPEFSIHSKFLEKQLKKDTAEPFQLDDQ

SEQ ID NO: 3629 - protein, 31 aa, Deltaretrovirus sp.
GTPTTRRPLQLLYSSLKGIDDPRAIIHLSPE

SEQ ID NO: 3630 - protein, 31 aa, Deltaretrovirus sp.
GTPTLRQPLHSLYCALQRHTDPRDQIYLNPS

SEQ ID NO: 3631 - protein, 31 aa, Deltaretrovirus sp.
GTPILRKHLQSLYSALHGYRDPRACITLTPQ

SEQ ID NO: 3632 - protein, 31 aa, Betaretrovirus sp.
YLKLTTGDLKPLFDTLKGDSDPNSHRSLSKE

SEQ ID NO: 3633 - protein, 31 aa, Betaretrovirus sp.
FLKLTTGELKPLFEILNGDSNPISTRKLTPE

SEQ ID NO: 3634 - protein, 31 aa, Betaretrovirus sp.
YLKLPTSALVPLNNILKGDPNPLSVRALTPE

SEQ ID NO: 3635 - protein, 29 aa, Spumavirus sp.
FIPNYSELVKPLYTIVANANGKFISWTED

SEQ ID NO: 3636 - protein, 29 aa, Spumavirus sp.
FIPNFAELVQPLYNLIASAKGKYIEWSEE

SEQ ID NO: 3637 - protein, 24 aa, synthetic construct
  source 1..24: note = Description of Artificial Sequence: Synthetic peptide
  VARIANT 6: note = I, V, D, T, S, L, E, or K
  VARIANT 16: note = E, A, P, Q, G, H, or S
  VARIANT 21: note = D, N, P, E, S, K, A, Q, Y, or T
FATAHXLGGLTSAGKXIKNKXEIL

SEQ ID NO: 3638 - protein, 31 aa, Gammaretrovirus sp.
FATAHIHGEIYRRRGLLTSEGKEIKNKDEIL

SEQ ID NO: 3639 - protein, 31 aa, Gammaretrovirus sp.
FATAHVHGEIYRRRGLLTSEGREIKNKNEIL

SEQ ID NO: 3640 - protein, 31 aa, Gammaretrovirus sp.
FATIHVHGMIYRERGLLTAGGKAIKNAPEIL

SEQ ID NO: 3641 - protein, 31 aa, Gammaretrovirus sp.
FATAHVHGAIYKQRGLLTSAGREIKNKEEIL

SEQ ID NO: 3642 - protein, 31 aa, Gammaretrovirus sp.
FATAHIHGEIYRRRGLLTSEGREIKNKSEIL

SEQ ID NO: 3643 - protein, 31 aa, Epsilonretrovirus sp.
YGVVHDFGHLWMHRGFVTSAGTPIKNHKEIE

SEQ ID NO: 3644 - protein, 22 aa, Deltaretrovirus sp.
YSLLRTLVLGAWLQPDPVPSYA

SEQ ID NO: 3645 - protein, 22 aa, Deltaretrovirus sp.
YHYLRTLALGTFQGRSSQAPFQ

SEQ ID NO: 3646 - protein, 22 aa, Deltaretrovirus sp.
IKYLHSLAIGAFLGTSAHQTLQ

SEQ ID NO: 3647 - protein, 23 aa, Betaretrovirus sp.
AHSIPLLETVAQIKHISETAKLF

SEQ ID NO: 3648 - protein, 22 aa, Betaretrovirus sp.
TGLFPEIETATLSPRTKIYTEL

SEQ ID NO: 3649 - protein, 23 aa, Betaretrovirus sp.
AQSVPLLETVPFIKSSTNATPLF

SEQ ID NO: 3650 - protein, 31 aa, Spumavirus sp.
AESANKELPYWKSNGFLNNKKKPLRHVSKWK

SEQ ID NO: 3651 - protein, 31 aa, Spumavirus sp.
AESANKELPYWKSNGFVNNKKKPLKHISKWK

SEQ ID NO: 3652 - protein, 30 aa, synthetic construct
  source 1..30: note = Description of Artificial Sequence: Synthetic polypeptide
  VARIANT 29: note = A, Q, K, H, or V
PKTLRQLQEFLGTIGWCRLWIPGFAELLXP

SEQ ID NO: 3653 - protein, 30 aa, Gammaretrovirus sp.
PKTPRQLREFLGTAGFCRLWIPGFAEMAAP

SEQ ID NO: 3654 - protein, 30 aa, Gammaretrovirus sp.
PKTKRQVREFLGTIGYCRLWIPGFAELAQP

SEQ ID NO: 3655 - protein, 30 aa, Gammaretrovirus sp.
PTTAKQVREFLGTAGFCRLWIPGFATLAAP

SEQ ID NO: 3656 - protein, 30 aa, Epsilonretrovirus sp.
PTTIRQIRAFLGLVGYCRHWIPEFSIHSKF

SEQ ID NO: 3657 - protein, 30 aa, Deltaretrovirus sp.
PISLHQLQTVLGDLQWVSRGTPTTRRPLQL

SEQ ID NO: 3658 - protein, 30 aa, Deltaretrovirus sp.
RWALPELQALLGEIQWVSKGTPTLRQPLHS

SEQ ID NO: 3659 - protein, 30 aa, Deltaretrovirus sp.
QWTLTELQVILGEIQWVSKGTPILRKHLQS

SEQ ID NO: 3660 - protein, 30 aa, Betaretrovirus sp.
LQTLNDFQKLLGDINWLRPYLKLTTGDLKP

SEQ ID NO: 3661 - protein, 30 aa, Betaretrovirus sp.
LRTLNDFQKLLGNINWIRPFLKLTTGELKP

SEQ ID NO: 3662 - protein, 30 aa, Betaretrovirus sp.
LKTLNDFQKLLGDIQWLRPYLKLPTSALVP

SEQ ID NO: 3663 - RNA, 100 nt, synthetic construct; identical to SEQ ID NO: 1683
  source 1..100: mol_type = other RNA
  misc_difference 1..100: note = This sequence may encompass 5, 10, 20, 30, 40, 50, 60, 70, 80, 90, or 100 nucleotides

SEQ ID NO: 3664 - RNA, 30 nt, synthetic construct
  source 1..30: mol_type = other RNA
  misc_difference 1..30: note = This sequence may encompass 5, 10, 20, or 30 nucleotides
aaaaaaaaaaaaaaaaaaaaaaaaaaaaaa

SEQ ID NO: 3665 - RNA, 100 nt, synthetic construct; identical to SEQ ID NO: 1683
  source 1..100: mol_type = other RNA
  misc_difference 1..100: note = This sequence may encompass 5, 10, 20, 30, 50, 70, or 100 nucleotides

SEQ ID NO: 3666 - RNA, 80 nt, synthetic construct
  source 1..80: mol_type = other RNA
aaaaaaaaaaaaaaaaaaaaaaaaaaaaaaaaaaaaaaaaaaaaaaaaaaaaaaaaaaaaaaaaaaaaaaaaaaaaaaaa
